United States Patent
Cowman et al.

(10) Patent No.: US 8,703,147 B2
(45) Date of Patent: Apr. 22, 2014

(54) METHODS AND COMPOSITIONS FOR TREATING AND PREVENTING MALARIA (2)

(75) Inventors: Alan Cowman, North Melbourne (AU); James Beeson, Caulfield South (AU); Alexander Gerd Maier, Coburg (AU); Kristina E. M. Persson, Skurup (SE); Jonathan S. Richards, Fitzroy (AU); Sash Lopaticki, St. Albans (AU)

(73) Assignee: The Walter and Eliza Hall Institute of Medical Research, Victoria (AU)

( * ) Notice: Subject to any disclaimer, the term of this patent is extended or adjusted under 35 U.S.C. 154(b) by 1187 days.

(21) Appl. No.: 12/265,638

(22) Filed: Nov. 5, 2008

(65) Prior Publication Data

US 2009/0202579 A1 Aug. 13, 2009

Related U.S. Application Data

(60) Provisional application No. 60/985,568, filed on Nov. 5, 2007.

(51) Int. Cl.
| | | |
|---|---|---|
| *A61K 39/00* | (2006.01) | |
| *A61K 39/002* | (2006.01) | |
| *A61K 39/015* | (2006.01) | |
| *C07K 1/00* | (2006.01) | |

(52) U.S. Cl.
USPC ............ 424/191.1; 424/184.1; 424/185.1; 424/265.1; 424/269.1; 424/272.1; 530/350

(58) Field of Classification Search
None
See application file for complete search history.

(56) References Cited

U.S. PATENT DOCUMENTS 7,025,961 B1 * 4/2006 Narum et al. ............ 424/130.1
2005/0075496 A1 * 4/2005 Druilhe et al. ............ 536/23.7

FOREIGN PATENT DOCUMENTS

| WO | WO 0211756 | * | 2/2002 |
| WO | WO 2005/018665 | * | 3/2005 |
| WO | WO 2008/033106 | * | 3/2008 |

OTHER PUBLICATIONS

Orlandi et al. Molecular and Biochemical Parasitology, 40 (1990) 285-294.*
Newman et al. Exp. Opin. Ther. Patents (2000) 10(3):279-314.*
Camus et al. Science vol. 230, Nov. 1985 p. 553-556.*
Persson et al (J. Clin Microbiol. May 2006;44(5):1665-73).*
Fangli et al. Zhongguo Ren Shou Gong Huan Bing Za Zhi (Chinese J of Zoonoses) 2000; 16(4):28-32.*
Genbank Accession # AY138500.1, Nov. 7, 2005. Printout 5 pages.*
Yadava et al. Infection and Immunity, Sep. 2003, p. 4961-4969.*
Amino acid sequence for erythrocyte binding antigen 175 of *P. falciparum* 3D7 strain (Uniprot Accession # Q8IBE8).*
Triglia et al. Infection and Immunity, Feb. 2001, p. 1084 to 1092.*

* cited by examiner

*Primary Examiner* — Oluwatosin Ogunbiyi
(74) *Attorney, Agent, or Firm* — Birch, Stewart, Kolasch & Birch, LLP

(57) ABSTRACT

The present invention provides compositions and methods useful in the treatment or prevention of a condition caused by or associated with infection by *Plasmodium falciparum*, such as malaria. The compositions include various antigens of *Plasmodium falciparum*, both alone and in combination. The invention further includes fragments of the antigens.

12 Claims, 22 Drawing Sheets

FIG 1
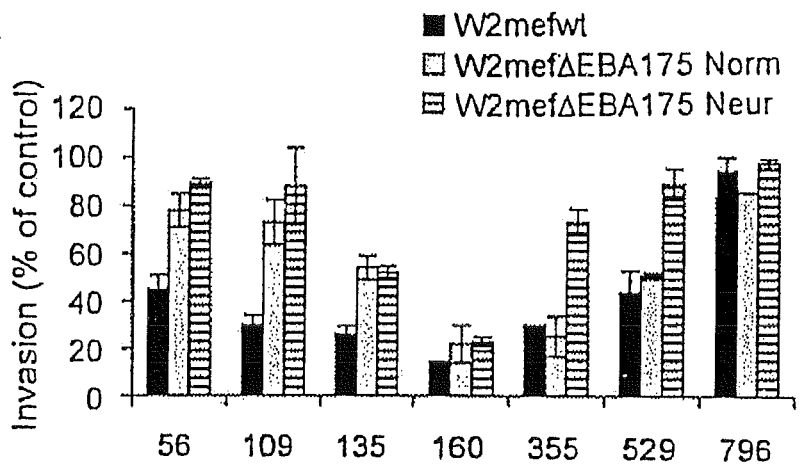
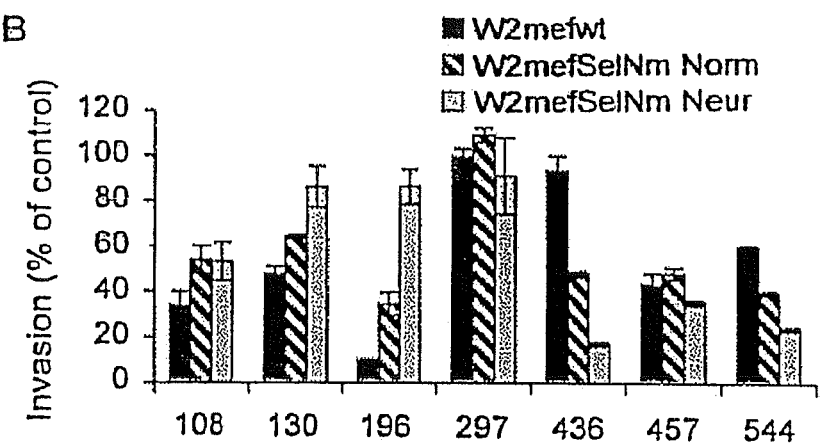
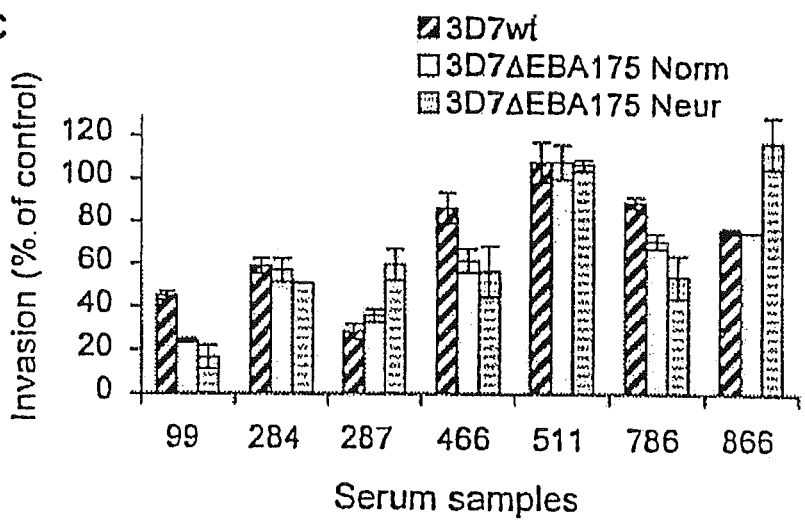

FIG 7
A
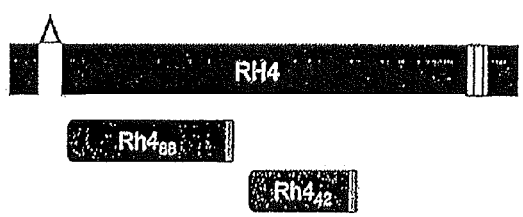
B 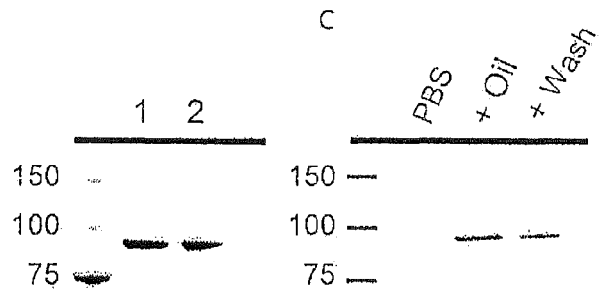 C
RH4₈₈ Expression
Coomassie Blue
RH4₈₈ RBC Binding
Anti-5XHIS
D
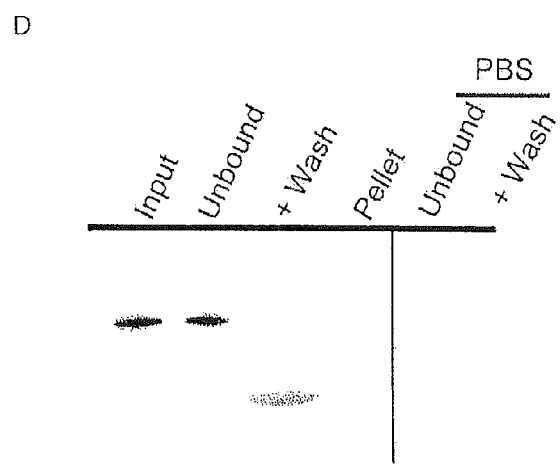
RH4₄₂ RBC Binding
Anti-5XHIS FIG 8
A
Rh2 - aa 2098 to 2597
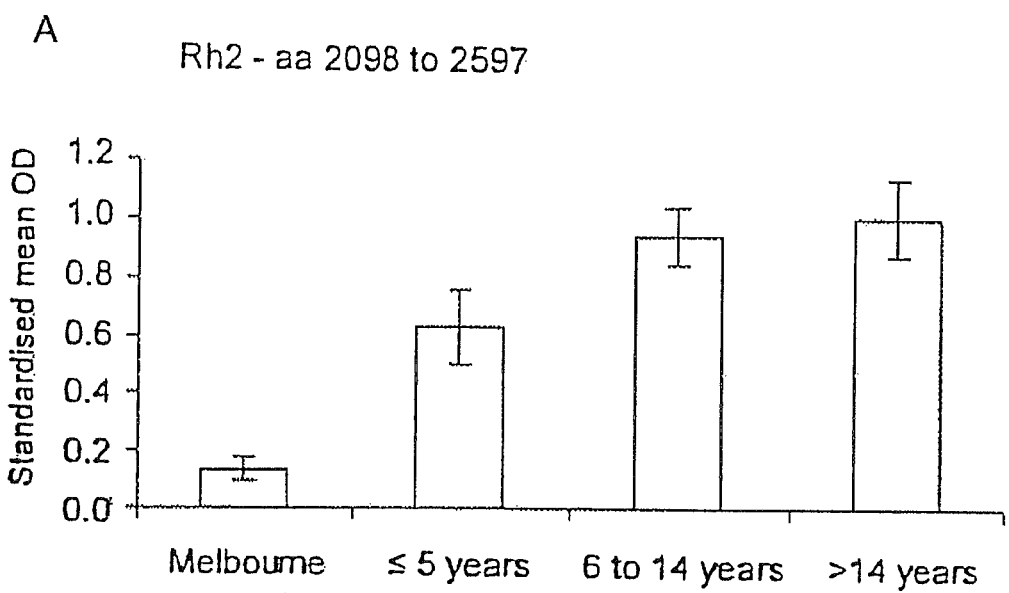
B
Rh2 - aa 2616 to 3115
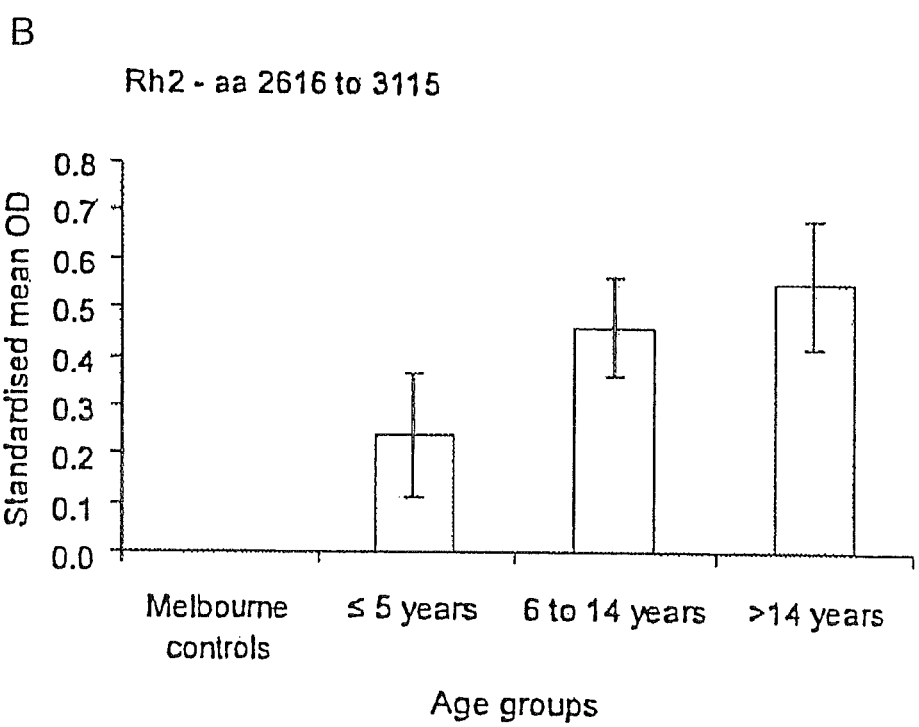

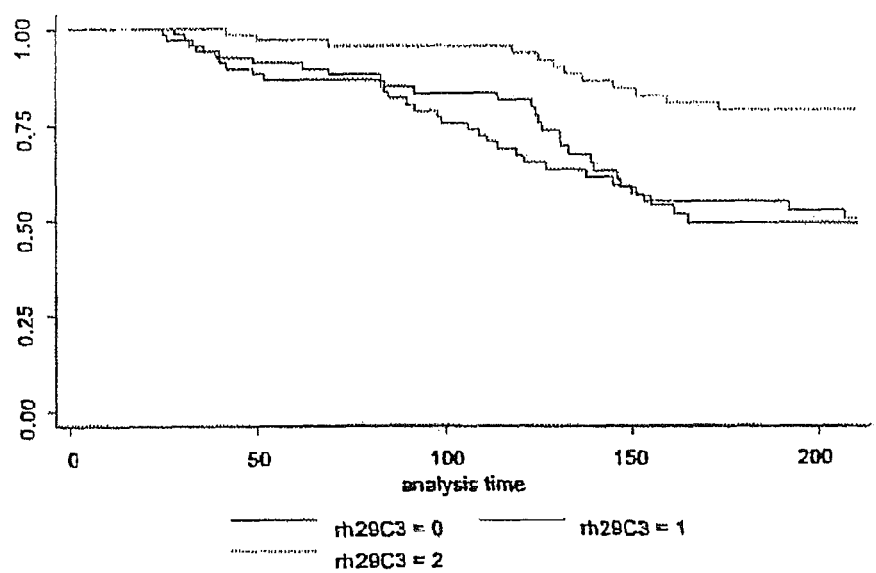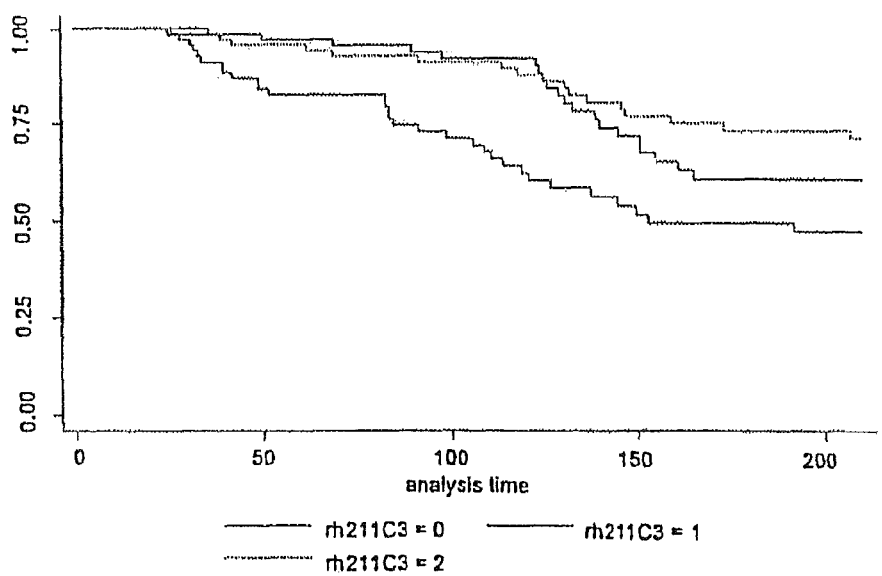
FIG 9

FIG 10
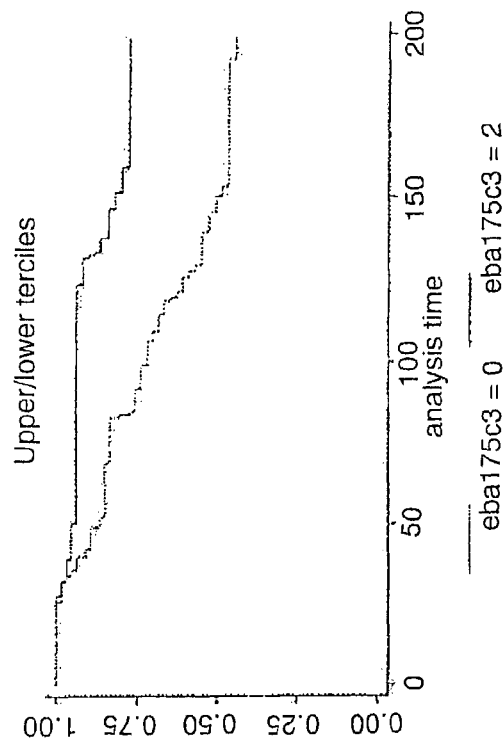
A. EBAs
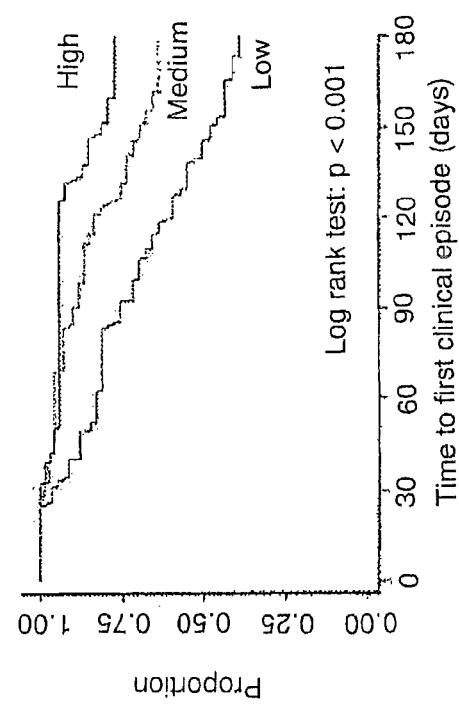
B. EBA175

FIG 10
C. EBA181
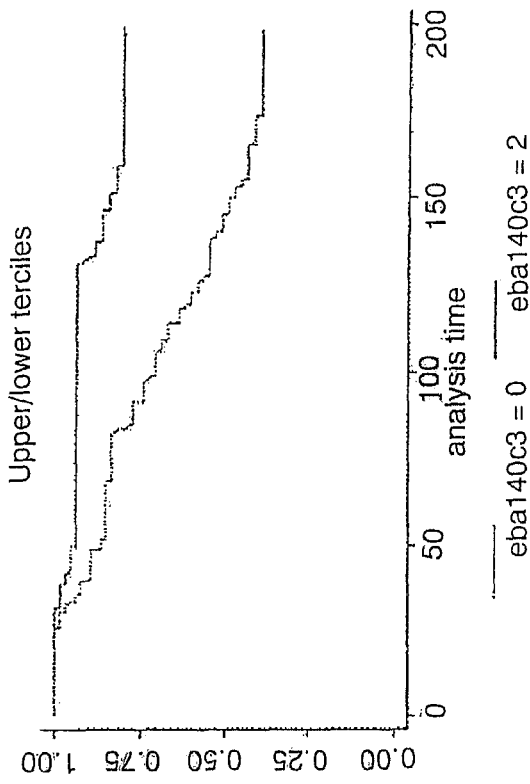
D. EBA140
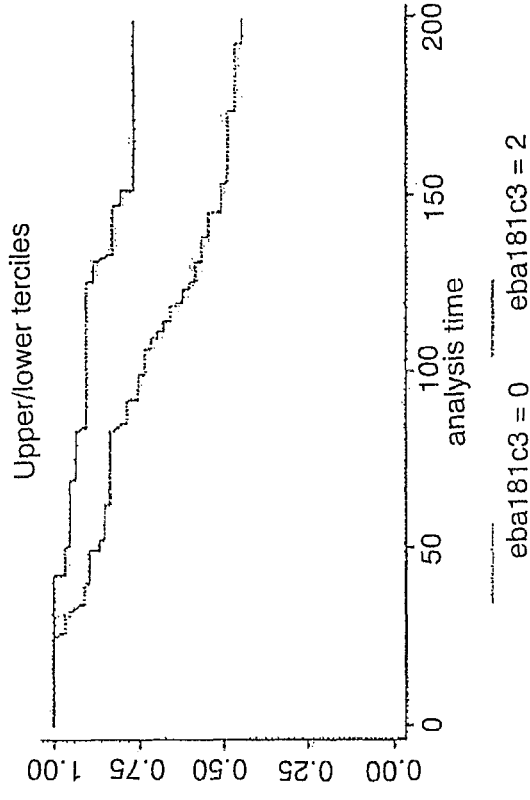

FIG 13
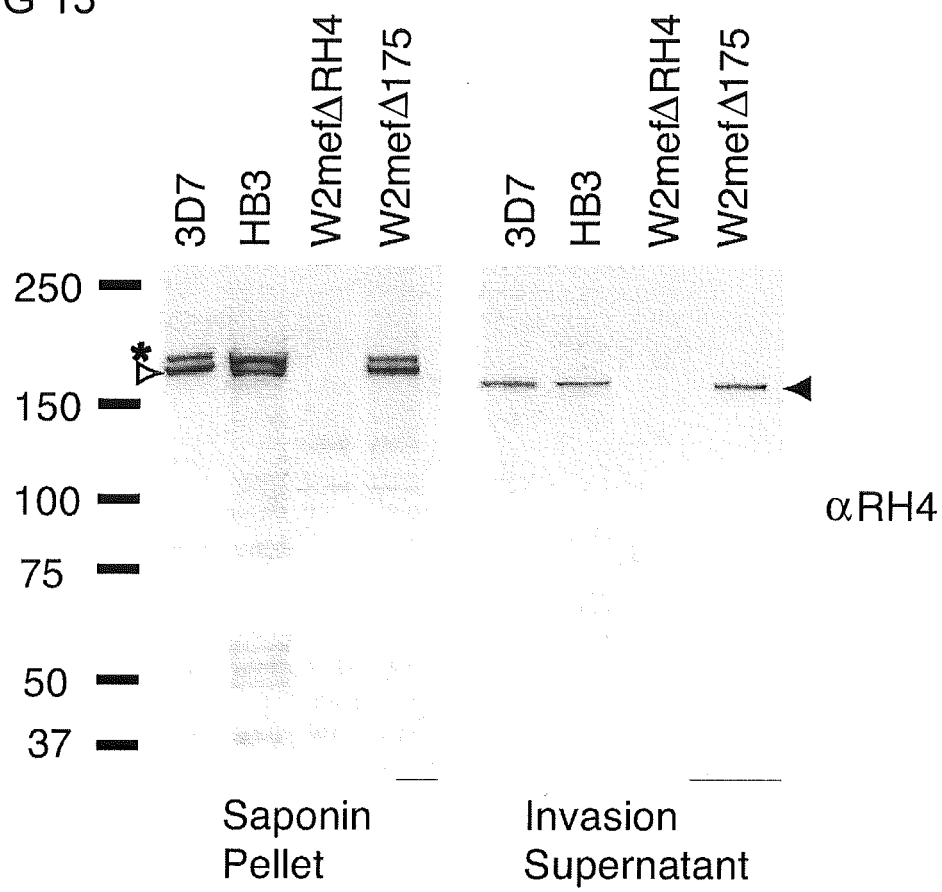
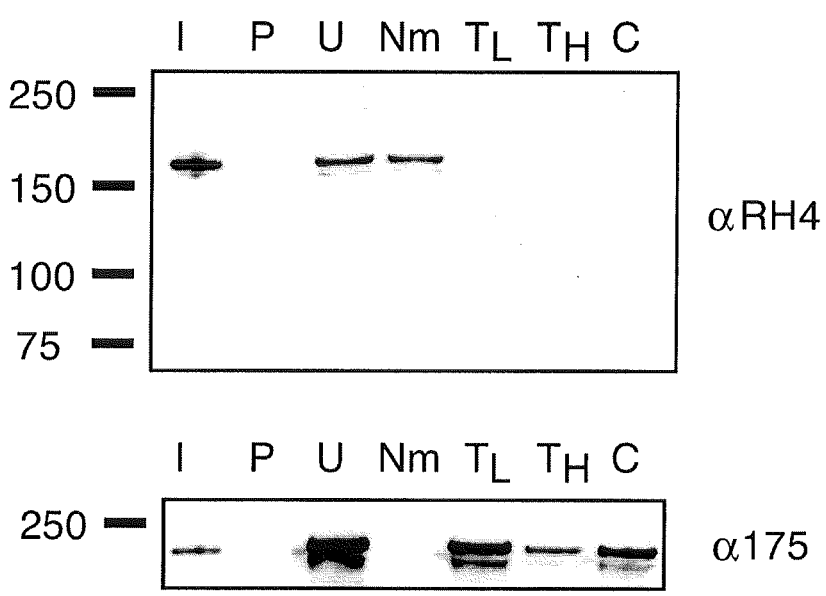

FIG 14
A
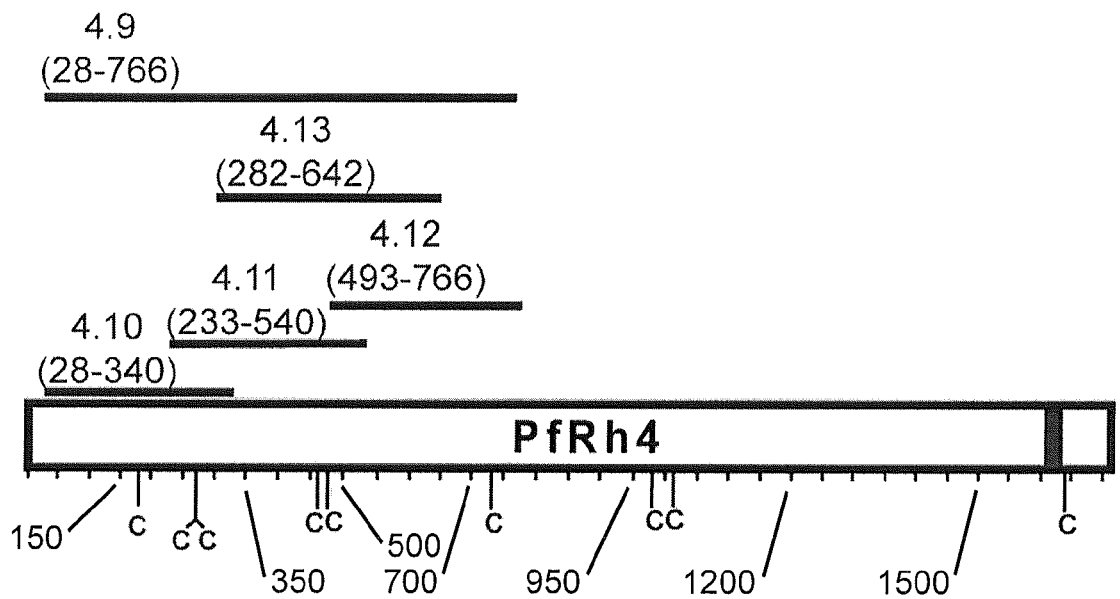
B
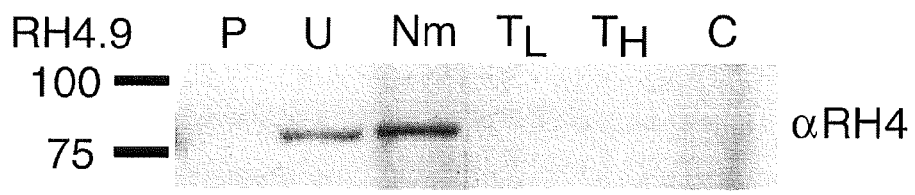
C
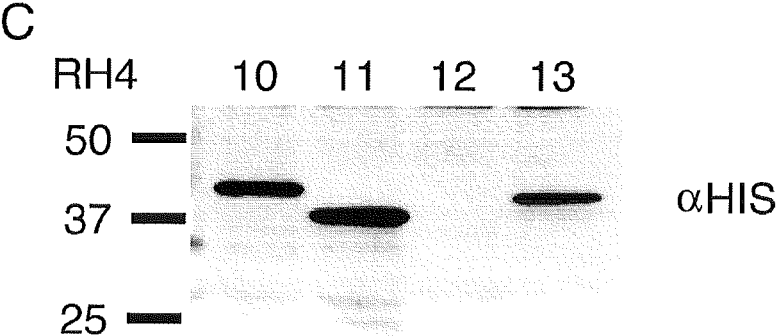

FIG 18
A
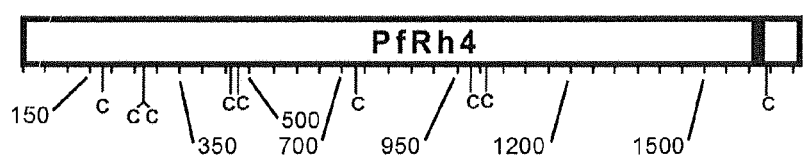
B
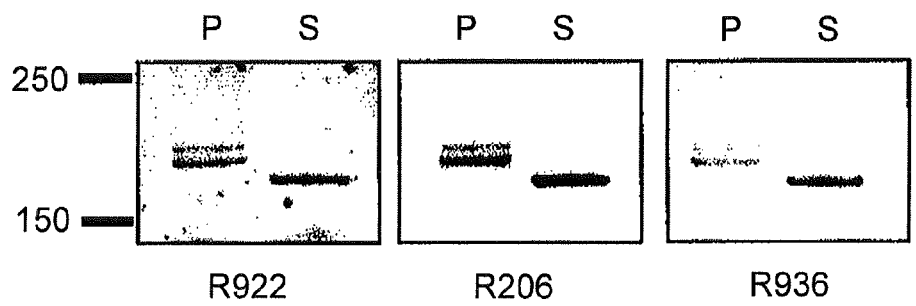

METHODS AND COMPOSITIONS FOR TREATING AND PREVENTING MALARIA (2)

This Nonprovisional application claims priority under 35 U.S.C. §119(a) on Patent Application No. 60/985,568 filed in United States of America on Nov. 5, 2007, the entire contents of which are hereby incorporated by reference.

FIELD OF THE INVENTION

The present invention relates to vaccines for the treatment and prevention of malaria. In particular the invention provides antigens capable of eliciting antibodies capable of preventing invasion of *Plasmodium* parasite into erythrocytes.

BACKGROUND

Human malaria is caused by infection with protozoan parasites of the genus *Plasmodium*. Four species are known to cause human disease: *Plasmodium falciparum, Plasmodium malariae, Plasmodium ovale* and *Plasmodium vivax*. However, *Plasmodium falciparum* is responsible for the majority of severe disease and death. Recent estimates of the annual number of clinical malaria cases worldwide range from 214 to 397 million (World Health Organization. The world health report 2002: reducing risks, promoting healthy life. Geneva: World Health Organization, 2002; Breman et al (2004) American Journal of Tropical Medicine and Hygiene 71 Suppl 2:1-15.), although a higher estimate of 515 million (range 300 to 660 million) clinical cases of *Plasmodium falciparum* in 2002 has been proposed (Snow et al. (2004) American Journal of Tropical Medicine and Hygiene 71(Suppl 2):16-24). Annual mortality (nearly all from *Plasmodium falciparum* malaria) is thought to be around 1.1 million (World Health Organization. The world health report 2002: reducing risks, promoting healthy life. Geneva: World Health Organization, 2002; Breman et al (2004) American Journal of Tropical Medicine and Hygiene 71 Suppl 2:1-15.). Malaria also significantly increases the risk of childhood death from other causes (Snow et al. (2004) American Journal of Tropical Medicine and Hygiene 71 Suppl 2:16-24). Almost half of the world's population lives in areas where they are exposed to risk of malaria (Hay et al (2004) Lancet Infectious Diseases 4(6):327-36), and the increasing numbers of visitors to endemic areas are also at risk. Despite continued efforts to control malaria, it remains a major health problem in many regions of the world, and new ways to prevent and/or treat the disease are urgently needed.

Early optimism for vaccines based on malarial proteins (so called subunit vaccines) has been tempered over the last two decades as the problems caused by allelic polymorphism and antigenic variation, original antigenic sin, and the difficulty of generating high levels of durable immunity emerged, and with the notable failures of many promising subunit vaccines (such as SPf66) have led to calls for a change in approach towards a malaria vaccine. Consequently, this growing sense of frustration has lead to the pursuit of different approaches that focus on attenuated strains of malaria parasite or irradiated *Plasmodium falciparum* sporozoites (Hoffmann et al. (2002) J Infect Dis 185(8):1155-64). Similarly, both the limited success achieved to date with protein-based vaccines and the recognition that cell mediated immunity may be critical to protection against hepatic and perhaps blood stages of the parasite has led to a push for DNA and vectored vaccines, which generate relatively strong cell mediated immunity. To date DNA vaccines have demonstrated poor efficacy in humans with respect to antibody induction (Wang et al. (2001) PNAS 98: 10817-10822).

To be effective, a malaria vaccine could prevent infection altogether or mitigate against severe disease and death in those who become infected despite vaccination. Four stages of the malaria parasite's life cycle have been the targets of vaccine development efforts. The first two stages are often grouped as 'pre-erythrocytic stages' (i.e. before the parasite invades the human red blood cells): these are the sporozoites inoculated by the mosquito into the human bloodstream, and the parasites developing inside human liver cells (hepatocytes). The other two targets are the stage when the parasite is invading or growing in the red blood cells (the asexual stage); and the gametocyte stage, when the parasites emerge from red blood cells and fuse to form a zygote inside the mosquito vector (gametocyte, gamete, or sexual stage). Vaccines based on the pre-erythrocytic stages usually aim to completely prevent infection. For asexual, blood stage vaccines, because the level of parasitaemia is in general proportional to the severity of disease (Miller, et al. (1994) Science 264, 1878-1883), vaccines aim to reduce or eliminate (e.g. induce stertile immunity) the parasite load once a person has been infected. However, most adults in malaria-endemic settings are clinically immune (e.g. do not suffer symptoms associated with malaria), but have parasites at low density in their blood. Gametocyte vaccines aim towards preventing the parasite being transmitted to others through mosquitoes. Ideally, a vaccine effective at all these parasite stages is desirable (Richie and Saul, Nature. (2002) 415(6872):694-701).

The SPf66 vaccine (Patorroyo et al. (1988) Nature 332: 158-161) is a synthetic hybrid peptide polymer containing amino acid sequences derived from three *Plasmodium falciparum* asexual blood stage proteins (83, 55, and 35 kilodaltons; the 83 kD protein corresponding to merozoite surface protein (MSP)-1) linked by repeat sequences from a protein found on the *Plasmodium falciparum* sporozoite surface (circumsporozoite protein). Therefore it is technically a multistage vaccine. SPf66 was one of the first types of vaccine to be tested in randomized controlled trials in endemic areas and is the vaccine that has undergone the most extensive field testing to date. While having marginal efficacy in four trials in South America (Valero et al. (1993) Lancet 341(8847):705-10. Valero et al. (1996) Lancet 348(9029):701-7; Sempertegui et al. (1994) Vaccine 12(4):337-42; Urdaneta et al. (1998) American Journal of Tropical Medicine and Hygiene 58(3): 378-85.), these trials suggested a slightly elevated incidence of *Plasmodium vivax* in the vaccine groups. The vaccine has also been demonstrated to be ineffective for reducing new malaria episodes, malaria prevalence, or serious outcomes (severe morbidity and mortality) in Africa (Alonso et al. Lancet 1994; 344(8931):1175-81 and Alonso et al Vaccine 12(2):181-6); D'Alessandro et al. (1995) Lancet 346(8973): 462-7; Leach et al. (1995) Parasite Immunology 1995; 17(8): 441-4; Masinde et al. (1998) American Journal of Tropical Medicine and Hygiene 59(4):600-5; Acosta 1999 Tropical Medicine and International Health 1999; 4(5):368-76) and Asia (Nosten et al. (1996) Lancet; 348(9029):701-7.), and is consequently no longer being tested.

Four types of pre-erythrocytic vaccines (CS-NANP; CS102; RTS,S; and ME-TRAP) have been trialed. The CS-NANP-based pre-erythrocytic vaccines were the first to be tested, beginning in the 1980s. The vaccines used in the first trials comprised three different formulations of the four amino acid B cell epitope NANP, which is present as multiple repeats in the circumsporozoite protein covering the surface of the sporozoites of *Plasmodium falciparum*. The number of NANP repeats in these vaccines varied from three to 19, and three different carrier proteins were used. The CS-NANP epitope alone appears to be ineffective in a vaccine, with no evidence for effectiveness of CS-NANP vaccines in three trials (Guiguemde et al. (1990) Bulletin de la Societe de Pathologie Exotique 83(2):217-27; Brown et al. (1994) Vaccine 12(2):102-7; Sherwood et al. (1996) Vaccine 14(8):817-27).

The CS102 vaccine is also based on the sporozoite CS protein, but it does not include the NANP epitope. It is a synthetic peptide consisting of a stretch of 102 amino acids containing T-cell epitopes from the C-terminal end of the molecule. All 14 participants in this small trial of non-immune individuals had malaria infection as detectable by PCR (Genton et al. (2005) Acta Tropica Suppl 95:84).

The RTS,S recombinant vaccine also includes the NANP epitope. It contains 19 NANP repeats plus the C terminus of the CS protein fused to hepatitis B surface antigen (HBsAg), expressed together with un-fused HBsAg in yeast. The resulting construct is formulated with the adjuvant ASO2/A. Thus the vaccine contains a large portion of the CS protein in addition to the NANP region, as well as the hepatitis B carrier. The RTS,S pre-erythrocytic vaccine has shown some modest efficacy, in particular with regard to prevention of severe malaria in children and duration of protection of 18 months (Kester et al. (2001) Journal of Infectious Diseases 2001; 183(4):640-7.1; Bojang et al. (2001) Lancet 358(9297):1927-34; Alonso et al. (2005) Lancet 366(9502):2012 Alonso et al. (2005) Lancet 366(9502):2012-8), Bojang et al. (2005) Vaccine 23(32):4148-57). In four trials, it was effective in preventing a significant number of clinical malaria episodes, including good protection against severe malaria in children, with no serious adverse effects (Graves et al. (2006) Cochrane Database of Systematic Reviews 4: CD006199). The RTS,S vaccine has shown significant efficacy against both experimental challenge (in non-immunes) and natural challenge (in participants living in endemic areas) with malaria. Although no evidence was found for efficacy of RTS,S against clinical malaria in adults in The Gambia in the first year of follow up, efficacy was observed in the second year after immunization, after a booster dose. However, there was no reduction in parasite densities (which positively associate with pathology). Nonetheless, in a recent study in Mozambique, the vaccine appeared to have efficacy in infants (Aponte et al. (2007) 370(9598) 1543-1551).

The ME-TRAP pre-erythrocytic vaccine is a DNA vaccine that uses the prime boost approach to immunization. It uses a malaria DNA sequence known as ME (multiple epitope)-TRAP (thrombospondin-related protein). The ME string contains 15 T-cell epitopes, 14 of which stimulate CD8 T-cells and the other of which stimulates CD4 T-cells, plus two B-cell epitopes from six pre-erythrocytic antigens of Plasmodium falciparum. It also contains two non-malarial CD4 T-cell epitopes and is fused in frame to the TRAP sequence. This sequence is given first as DNA (two doses) followed by one dose of the same DNA sequence in the viral vector MVA (modified vaccinia virus Ankara). There was no evidence for effectiveness of ME-TRAP vaccine in preventing new infections or clinical malaria episodes, and the vaccine did not reduce the density of parasites or increase mean packed cell volume (a measure of anaemia) in semi-immune adult males (Moorthy et al. (2004) Nature 363(9403), 150-6).

The first blood-stage vaccine to be tested in challenge trials is Combination B, which is a mixture of three recombinant asexual blood-stage antigens: parts of two merozoite surface proteins (MSP-1 and MSP-2) together with a part of the ring-infected erythrocyte surface antigen (RESA), which is found on the inner surface of the infected red cell membrane. The MSP-1 antigen is a 175 amino acid fragment of the relatively conserved blocks 3 and 4 of the K1 parasite line; it also includes a T-cell epitope from the *Plasmodium falciparum* circumsporozoite (CS) protein as part of the MSP1 fusion protein. The MSP2 protein includes the nearly complete sequence from one allelic form (3D7) of the polymorphic MSP-2 protein. The RESA antigen consists of 70% of the native protein from the C-terminal end of the molecule. A small efficacy trial of Combination B in non-immune adults with experimental challenge showed no effect (Lawrence (2000) Vaccine 18(18):1925-31). In the single natural-challenge efficacy trial of in semi-immune children (Genton (2002) Journal of Infectious Diseases 185(6):820-7), no effect on clinical malaria infections was detected. In this trial, significant efficacy (measure by reduction in parasite density) was only observable in the group who were not pretreated with sulfadoxine-pyrimethamine. Also, in these children there was a reduction in the proportion of children with medium and high parasitaemia levels. Vaccinees in the Genton et al. (2002) trial had a lower incidence and prevalence of parasites with the 3D7 type of MSP2 (the type included in the vaccine) than the placebo group, and a higher incidence of malaria episodes were associated with the FC27 type of MSP2, suggesting specific immunity. Importantly, there was no statistically significant change in prevalence of parasitemia, nor was there evidence for an effect of combination B against episodes of clinical malaria in either the group pretreated with the antimalarial or the group with no antimalarial, in fact the results for these subgroups tended in the opposite direction. Furthermore, the relative role of the three vaccine constituents cannot be assessed when based on the trials that have been carried out to date.

In addition to the asexual-stage components of Combination B, many other potential asexual stage vaccines have been under preclinical evaluation, such as regions of apical membrane antigen 1 (AMA1), the merozoite surface proteins MSP1, MSP2, MSP3, MSP4, and MSP5: glutamate-rich protein (GLURP), rhoptry associated protein-2 (RAP2), EBA-175, EBP2, MAEBL, and DBP, and *Plasmodium falciparum* (erythrocyte membrane protein-1 (PfEMP1). Importantly however, a recent examination of the vaccine candidate still under consideration (Moran et al. (2007) The Malaria Product Pipeline, The George Institute for International Health, September 2007) has shown that many preclinical vaccine projects are problematic; in particular vaccine projects using the F2 domain of EBA-175 (e.g. by ICGEB), EBA-140 (also known as BAEBL), and RAP-2 are problematic. The problems associated with these projects highlight that much work is needed to find blood stage antigens that will afford a protective immune response. There are many problems faced in the selection of antigens for malaria vaccine development, including antigenic variation, antigen polymorphism, and original antigenic sin, and further problems such as MHC-limited non-responsiveness to malarial antigens, inhibition of antigen presentation, and the influence of maternal antibodies on the development of the immune system in infants.

Many blood stage vaccine candidates, such as MSP-1, MSP-2, MSP-3 and AMA-1, have substantial polymorphisms that may have an impact on both immunogenicity and protective effects, and in the case of MSP-1, and MSP-2, immune responses to particular allelic forms has been observed in vaccine trials (and also for MSP-3 and AMA-1 in mice). Molecular epidemiological studies can guide antigen selection and vaccine design as well as provide information that is needed to measure and interpret population responses to vaccines, both during efficacy trials and after introduction of vaccines into the population. They also may provide insight into the selective forces acting on antigen genes and potential implications of allele specific immunity. Consequently the different allelic forms would need to be included in any vaccine to counter the affect of antigenic polymorphism at immunogenic residues.

The cyclical recrudescences of malaria parasites in humans is thought to be due to the selective pressure placed upon parasitized red cells by antibodies to variant antigens, such as PfEMP1. *Plasmodium falciparum* possesses about 50 variant copies of PfEMP1 which are expressed clonally such that only one is expressed at a time, and the development of antibodies against the expanding clonal type then reduce this clone from the affected individual, and subsequently a different variant, not recognized by antibodies, emerges and cycling continues. This antigenic variation also poses a problem for vaccines containing clonally expressed antigens, and immunization studies with recombinant conserved CD36-binding portion of PfEMP1 failed to confer protection in Aotus monkeys (Makobongo et al. (2006) JID 193:731-740.

A third problem confounding malaria vaccine initiatives is original antigenic sin; a phenomenon in which individuals tend to make antibodies only to epitopes expressed on antigenic types to which they have been exposed (or cross-reactive antigens), even in subsequent infections carrying additional, highly immunogenic epitopes (Good, et al. (1993) Parasite Immunol. 15, 187-193. Taylor et al. (1996) Int. Immunol. 8, 905-915, Riley, (1996) Parasitology 112, S39-S51 (1996)).

It has also been proposed that immunity to malaria relies on maintaining high levels of immune effector cells, rather than in the generation of effectors from resting memory cells (Struck and Riley (2004) Immunological Reviews 201: 268-290). Consequently, the time taken to generate sufficient levels of effector cells may be crucial in determining whether a protective memory response can be mounted to prevent disease. Also, malaria parasites may interfere directly with memory responses by interfering with antigen presentation by dendritic cells (Urban et al. (1999) Nature 400:73-77, Urban et al. (2001) PNAS 98:8750-8755), and premature apoptosis of memory cells (Toure-Balde et al. (1996) Infection and Immunity 64: 744-750, Balde et al. (2000) Parasite Immunology 22:307-318).

Furthermore, it has been demonstrated that antibodies to particular malarial antigens (such as MSP-1) may inhibit the activity of malaria-protective antibodies (Holder et al (1999) Parassitologica 41:409-14), and that there may be MHC-limited non-responsiveness to malarial antigens (Tian et al (1996) J Immunol 157:1176-1183, Stanisic et al. (2003) Infection and Immunity 71: 5700-5713). Maternally derived antibodies have also been shown to interfere with the development of antibody responses in infants, and has been implicated for malaria in mice (Hirunpetcharat and Good (1998) PNAS 95:1715-1720), consequently these problems need to be addressed for vaccination of children against malaria.

As will be apparent from the foregoing review of the prior art, there remained significant problems to be overcome in the design of an efficacious vaccine against malaria. It is an aspect of the present invention to overcome or ameliorate a problem of the prior art by providing antigens capable of eliciting antibodies that can treat or prevent malaria.

A reference herein to a patent document or other matter which is given as prior art is not to be taken as an admission that that document or matter was known or that the information it contains was part of the common general knowledge as at the priority date of any of the claims.

SUMMARY OF THE INVENTION

The present invention provides an immunogenic molecule comprising a contiguous amino acid sequence of an erythrocyte binding antigen (EBA) protein of a strain of *Plasmodium falciparum*, wherein when administered to a subject the molecule is capable of inducing an invasion-inhibitory immune response to the strain. The EBA protein may be EBA175, EBA140, or EBA181. The contiguous amino acid sequence comprises about 5, 8, 10, 20, 50 or 100 or more amino acids.

The contiguous amino acid sequence may be found in the region between the F2 domain and the transmembrane domain of the EBA protein. The contiguous amino acid sequence may be found in the region from about residue 746 to about residue 1339 of the EBA protein. In one form of the immunogenic molecule the EBA is EBA140. In one form the contiguous amino acid sequence is found in the region between the F2 domain and the transmembrane domain of EBA140, or in the region from about residue 746 to about residue 1045 of EBA140.

In another form of the immunogenic molecule the EBA is EBA175. In one form of the immunogenic molecule the contiguous amino acid sequence is found in the region between the F2 domain and the transmembrane domain of EBA175. The contiguous amino acid sequence may be found in the region from about residue 761 to about residue 1271 of EBA175.

In another form of the invention the EBA is EBA181. In one form of the invention the contiguous amino acid sequence may be found in the region between the F2 domain and the transmembrane domain of EBA181. In another form of the immunogenic molecule the contiguous amino acid sequence is found in the region from about residue 755 to about residue 1339 of EBA181.

Another aspect of the present invention provides a composition comprising an immunogenic molecule as described herein and a pharmaceutically acceptable excipient and optionally a vaccine adjuvant.

Yet a further aspect of the present invention provides a composition comprising a contiguous amino acid sequence of an invasion ligand of a strain of *Plasmodium falciparum* involved in sialic-acid-dependant invasion of red cells further comprising a contiguous amino acid sequence of an invasion ligand of a strain of *Plasmodium falciparum* involved in sialic-acid-independent invasion of red cells wherein when administered to a subject the composition is capable of inducing an invasion-inhibitory immune response to the strain.

The composition may comprise an immunogenic molecule comprising a contiguous amino acid sequence of a reticulocyte-binding protein homologue (Rh) protein of the strain of *Plasmodium falciparum*, wherein when administered to a subject the Rh protein is capable of inducing an invasion-inhibitory immune response to the strain. The Rh may be Rh1, Rh2a, Rh2b or Rh4.

In one form of the composition the Rh is Rh2b. In another form of the immunogenic molecule the contiguous amino acid sequence is found in the region between about 31 amino acids N-terminal of the Prodom PD006364 homology region to about the transmembrane domain of Rh2b.

In one form of the composition the RH2b has a sequence disclosed in a GenBank accession number selected from the group consisting of AY138500 (SEQ ID NO: 38), AY138501 (SEQ ID NO: 39), AY138502 (SEQ ID NO: 40) and AY138503 (SEQ ID NO: 41).

In one form of the composition the contiguous amino acid sequence is found in the region from about residue 2027 to 3115 of Rh2b, or the region from about residue 2027 to about residue 2533 of Rh2b, or the region from about residue 2098 to about residue 2597 of Rh2b, or the region from about residue 2616 to about residue 3115 of Rh2b, or the region from about residue 1288 to about residue 1856 of Rh2b or the region from about residue 297 to about residue 726 of Rh2b or the region from about residue 34 to about residue 322 of Rh2b or the region from about residue 673 to about residue 1288 of Rh2b or the region from about residue 2030 to about residue 2528 of Rh2b or the region from about residue 2792 to about residue 3185 of Rh2b.

In one form of the composition the Rh is Rh2a. In one form of the composition the contiguous amino acid sequence is found in the region between about 31 amino acids N-terminal of the Prodom PD006364 homology region to about the transmembrane domain of Rh2a.

In one form of the composition the Rh2a has the sequence disclosed in a GenBank accession number selected from the group consisting of AY138496 (SEQ ID NO: 42), AY138497 (SEQ ID NO: 43), AY138498 (SEQ ID NO: 44) and AY138499 (SEQ ID NO: 45).

In one form of the composition the contiguous amino acid sequence is found in the region from about residue 2027 to 3115 of Rh2a, or the region from about residue 2027 to about residue 2533 of Rh2a, or the region from about residue 2098 to about residue 2597 of Rh2a, or the region from about residue 2616 to about residue 3115 of Rh2a, or the region from about residue 1288 to about residue 1856 of Rh2a or the region from about residue 297 to about residue 726 of Rh2a or the region from about residue 34 to about residue 322 of Rh2a or the region from about residue 673 to about residue 1288 of Rh2a or the region from about residue 2030 to about residue 2528 of Rh2a or the region from about residue 2530 to about residue 3029 of Rh2a, or the region from about residue 2133 to about residue 3065 of Rh2a.

In one form of the composition the Rh is Rh1. In one form of the composition the contiguous amino acid sequence is found in the region between about residue 1 to about the transmembrane domain of Rh1, or the region from about residue 1 to about residue 2897 of Rh1.

In one form of the composition the Rh1 has a sequence disclosed in a GenBank accession number selected from the group consisting of AF533700 (SEQ ID NO: 46), AF411933 (SEQ ID NO: 47), AF411930 (SEQ ID NO: 48), AF411931 (SEQ ID NO: 49) and AF411929 (SEQ ID NO: 50).

In one form of the composition the Rh is Rh4. In another form of the composition the contiguous amino acid sequence is found in the region from about the MTH1187/YkoF-like superfamily domain to about the transmembrane domain of Rh4. In a further form of the composition the contiguous amino acid sequence is found in the region from about residue 1160 to about residue 1370 of Rh4, or the region from about residue 28 to about residue 766 of Rh4, or the region from about residue 282 to about residue 642 of Rh4, or the region from about residue 233 to about residue 540 of Rh4, or the region from about residue 28 to about residue 340 of Rh4, or the region from about residue 1277 to about residue 1451 of Rh4, or the region from about residue 29 to about residue 766 of Rh4.

In one form of the composition the Rh4 has a sequence disclosed in a GenBank accession number selected from the group consisting of AF432854 (SEQ ID NO: 51) and AF420309 (SEQ ID NO: 52).

The contiguous amino acid sequence may comprise about 5, 8, 10, 20, 50 or 100 or more amino acids. The strain of *Plasmodium falciparum* may be a wild type strain.

In the compositions of the present invention the following combinations of EBA and Rh molecules are particularly preferred: (i) EBA175 and Rh2 (2a or 2b), (ii) EBA175 and EBA140 and Rh2 (2a or 2b), and (iii) EBA175 and Rh1 and Rh2. The combinations defined at (i), (ii) and (iii) may also be further combined with an Rh4 molecule and/or an EBA181 molecule. In referring to an Rh or EBA molecule, it is to be understood that this includes the use of the whole polypeptide molecule or any of the contiguous amino acid sequences of such Rh or EBA molecule.

In another aspect the present invention provides a method of treating or preventing a condition caused by or associated with infection by *Plasmodium falciparum* comprising administering to a subject in need thereof an effective amount of a composition as disclosed herein.

A further aspect provides use of a composition as described herein in the manufacture of a medicament for the treatment or prevention of a condition caused by or associated with infection by *Plasmodium falciparum*.

A further aspect of the present invention provides a method of screening for the presence of a *Plasmodium falciparum* invasion-inhibitory antibody directed against an erythrocyte binding antigen (EBA) of a strain of *Plasmodium falciparum* in a subject, comprising obtaining a biological sample from the subject and identifying the presence or absence of an antibody capable of binding to an immunogenic molecule as described herein.

A further aspect of the present invention provides a method of screening for the presence of a *Plasmodium falciparum* invasion-inhibitory antibody directed against a reticulocyte-binding homologue protein (Rh) of a strain of *Plasmodium falciparum* in a subject, comprising obtaining a biological sample from the subject and identifying the presence or absence of an antibody capable of binding to an immunogenic molecule as described herein. The method may further comprise identifying the presence of a *Plasmodium falciparum* invasion-inhibitory antibody directed against an erythrocyte binding antigen (EBA) of a strain of *Plasmodium falciparum* in a subject comprising identifying the presence or absence of an antibody capable of binding to an immunogenic molecule as described herein.

Throughout the description and the claims of this specification the word "comprise" and variations of the word, such as "comprising" and "comprises" is not intended to exclude other additives, components, integers or steps.

BRIEF DESCRIPTION OF THE FIGURES

FIG. 1. Inhibition of different *Plasmodium falciparum* lines by serum antibodies from malaria exposed Kenyan children and adults.

Results shown were selected to demonstrate representative examples of the inhibitory activities observed. Values are expressed as a percentage of invasion using non-exposed donors. All samples were tested in duplicate; values represent mean range. A) Inhibition of W2mef-wt compared to W2mefΔEBA175 cultured with normal or neuraminidase-treated erythrocytes. B) Inhibition of W2mef-wt compared to W2mef-SelNm cultured with normal or neuraminidase-treated erythrocytes. C) Inhibition of 3D7-wt compared to 3D7ΔEBA175 cultured with normal or neuraminidase-treated erythrocytes. Numbers on the X-axis are study codes for individual serum samples. Norm, cultured with normal erythrocytes. Neur, cultured with neuraminidase-treated erythrocytes.

Figure 2:
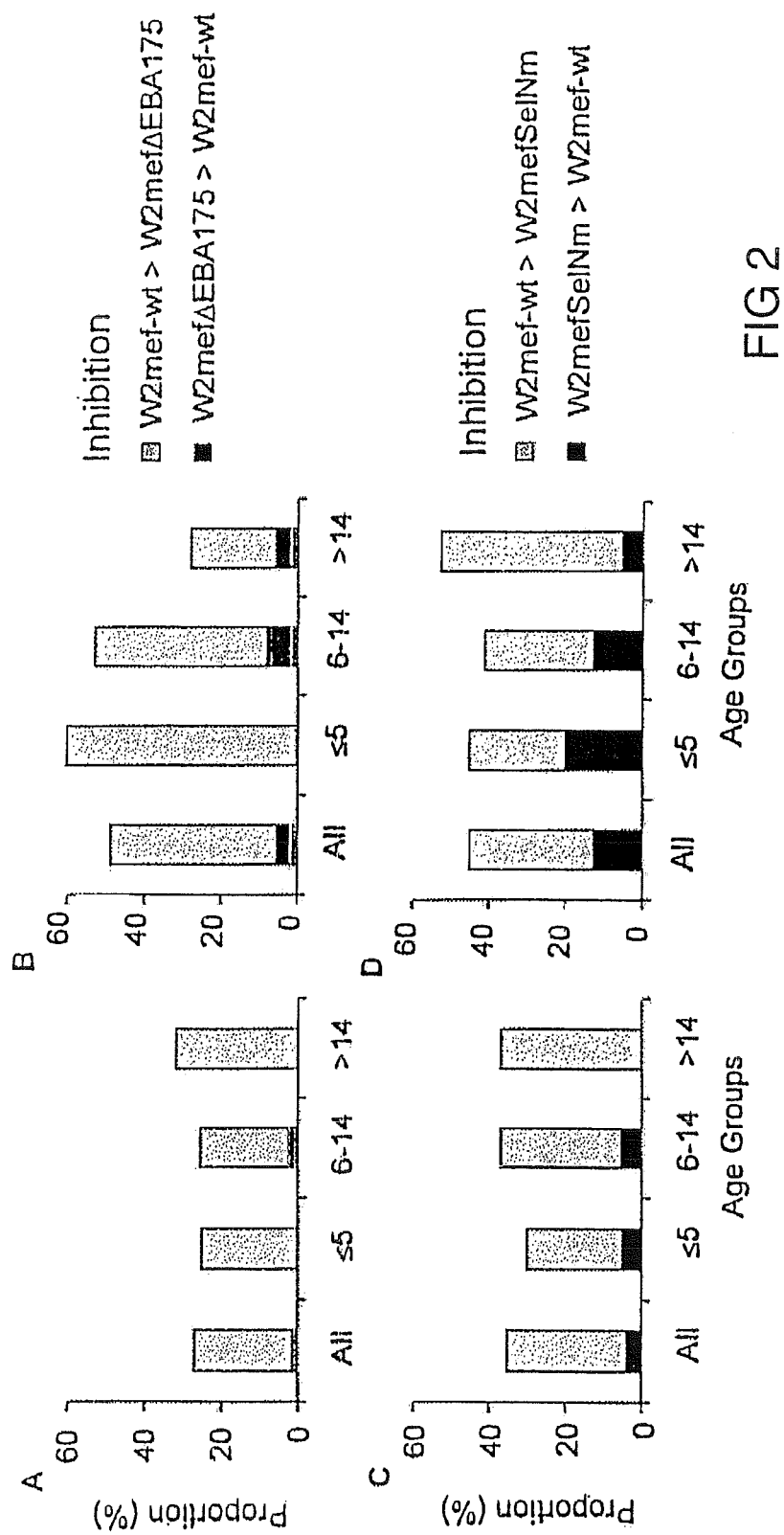

FIG. 2. Differential inhibition of W2mef *Plasmodium falciparum* lines by serum antibodies from malaria-exposed Kenyan children and adults.

Results show the proportion of sera (n=80) that differentially inhibited the two parasite lines tested for each comparison shown. Grey bars show the proportion of samples that inhibited the parental wild-type parasite line more than the W2mefΔEBA175 line or W2mefselNm line (type-A response). Black bars show the proportion of samples that inhibited the W2mefΔEBA175 line or W2mefselNm line more than the corresponding parental line (type-B response). The proportion with differential inhibitory activity is shown for all samples and separately by age groups (≤5, 6-14, and >14 years of age). A, B) W2mef-wt compared to W2mefΔEBA175 cultured with normal (A) or neuraminidase-treated (B) erythrocytes. C, D) W2mef-wt compared to W2mefSelNm cultured with normal (C) or neuraminidase-treated (D) erythrocytes. W2mef-wt was cultured with normal erythrocytes in all assays. Differences between the age groups were not statistically significant.

Figure 3:
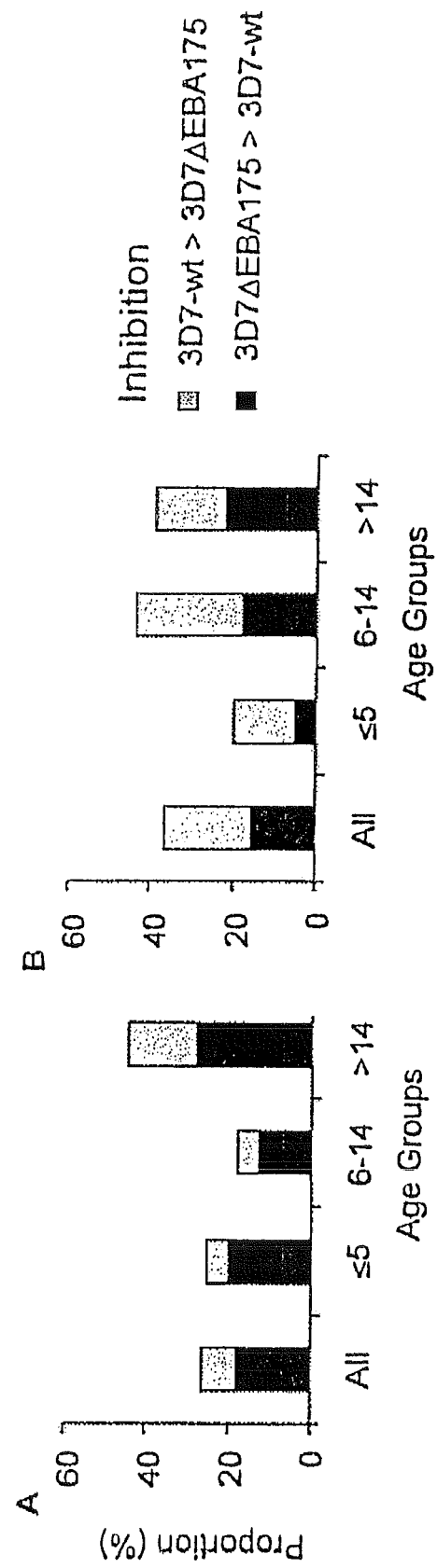

FIG. 3. Differential inhibition of 3D7 *Plasmodium falciparum* lines by serum antibodies from malaria-exposed Kenyan children and adults.

Results show the proportion of sera (n=80) that differentially inhibited the two parasite lines tested for each comparison shown. Grey bars show the proportion of samples that inhibited parental 3D7 (3D7-wt) more than 3D7ΔEBA175 (type-A response). Black bars show the proportion of samples that inhibited 3D7ΔEBA175 more than the parental 3D7 (type-B response). The proportion with differential inhibitory activity is shown for all samples and separately by age groups (≤5, 6-14, and >14 years of age). Comparisons are shown with 3D7ΔEBA175 cultured with normal (A) or neuraminidase-treated (B) erythrocytes. 3D7-wt was cultured with normal erythrocytes in all assays. Differences between the age groups were not statistically significant.

Figure 4:
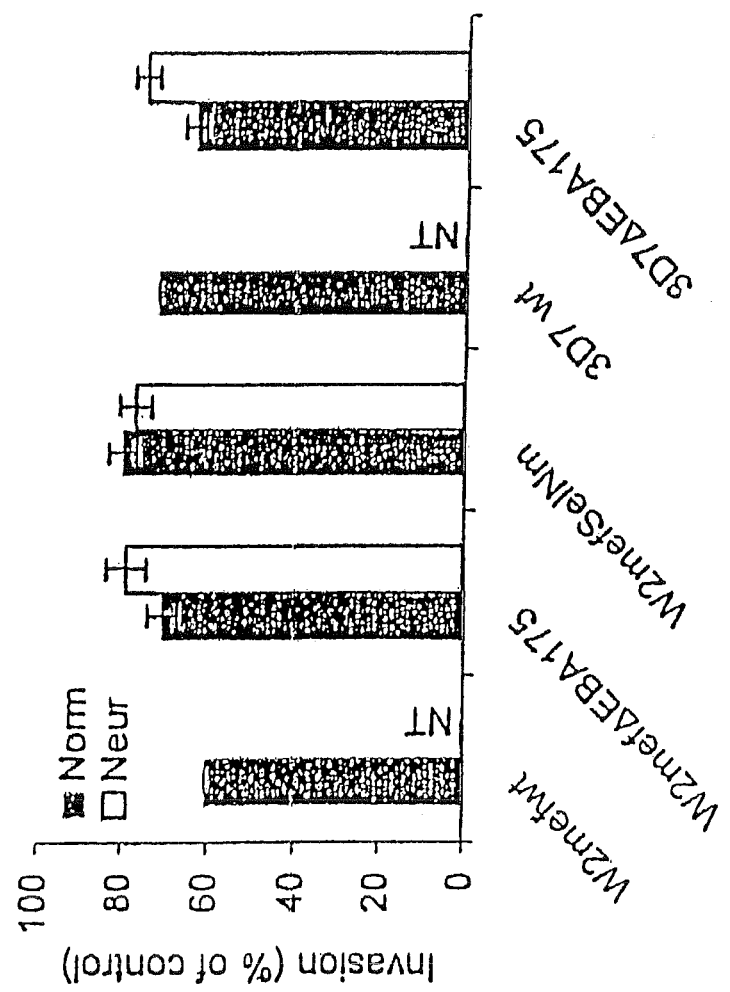

FIG. 4. The effect of serum antibodies from Kenyan donors on erythrocyte invasion by different *Plasmodium falciparum* lines.

Results represent the mean from testing 80 Kenyan serum antibody samples; error bars represent 95% confidence intervals. Values are expressed relative to control samples from non-exposed donors. Samples were not tested for inhibition of 3D7-wt or W2mef-wt invasion into neuraminidase-treated erythrocytes (NT, not tested). Numbers on the X-axis are study codes for individual serum samples. Norm, invasion into normal erythrocytes. Neur, invasion into neuraminidase-treated erythrocyte.

Figure 5:
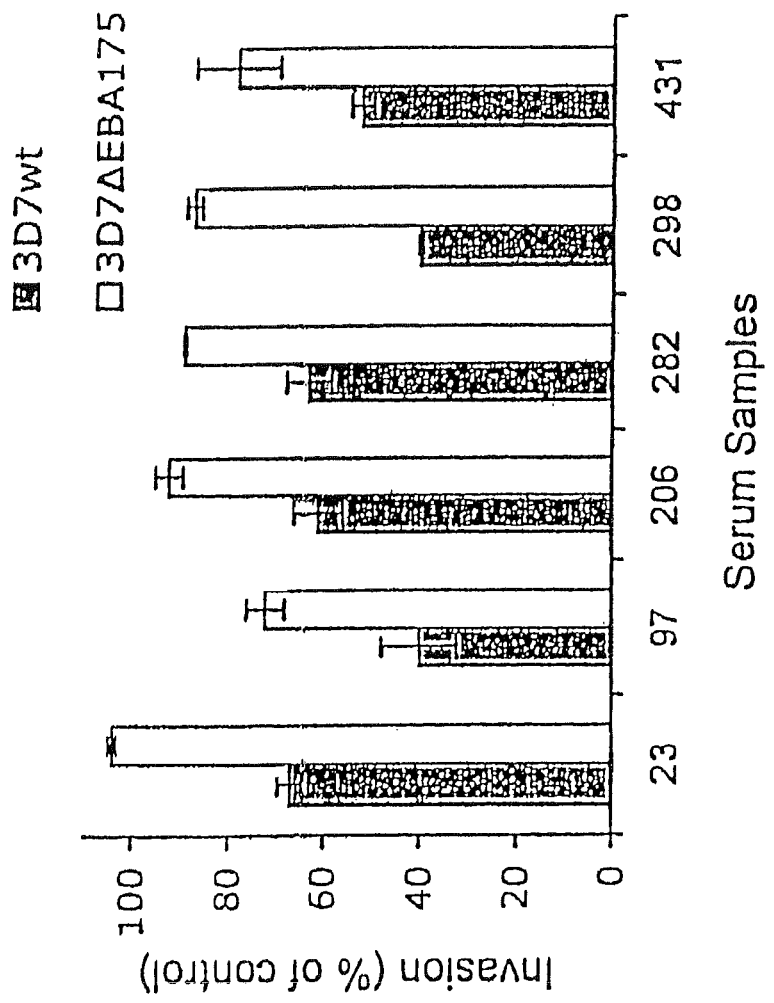

FIG. 5. Differential inhibition of 3D7-wt and 3D7ΔEBA175 by serum antibodies.

A selection of individual samples is shown that inhibit 3D7-wt to a greater extent than 3D7ΔEBA175. This suggests the presence of inhibitory antibodies against EBA175. Values are expressed as a percentage of invasion using non-exposed donors. All samples were tested in duplicate; values represent mean±range.

Figure 6:
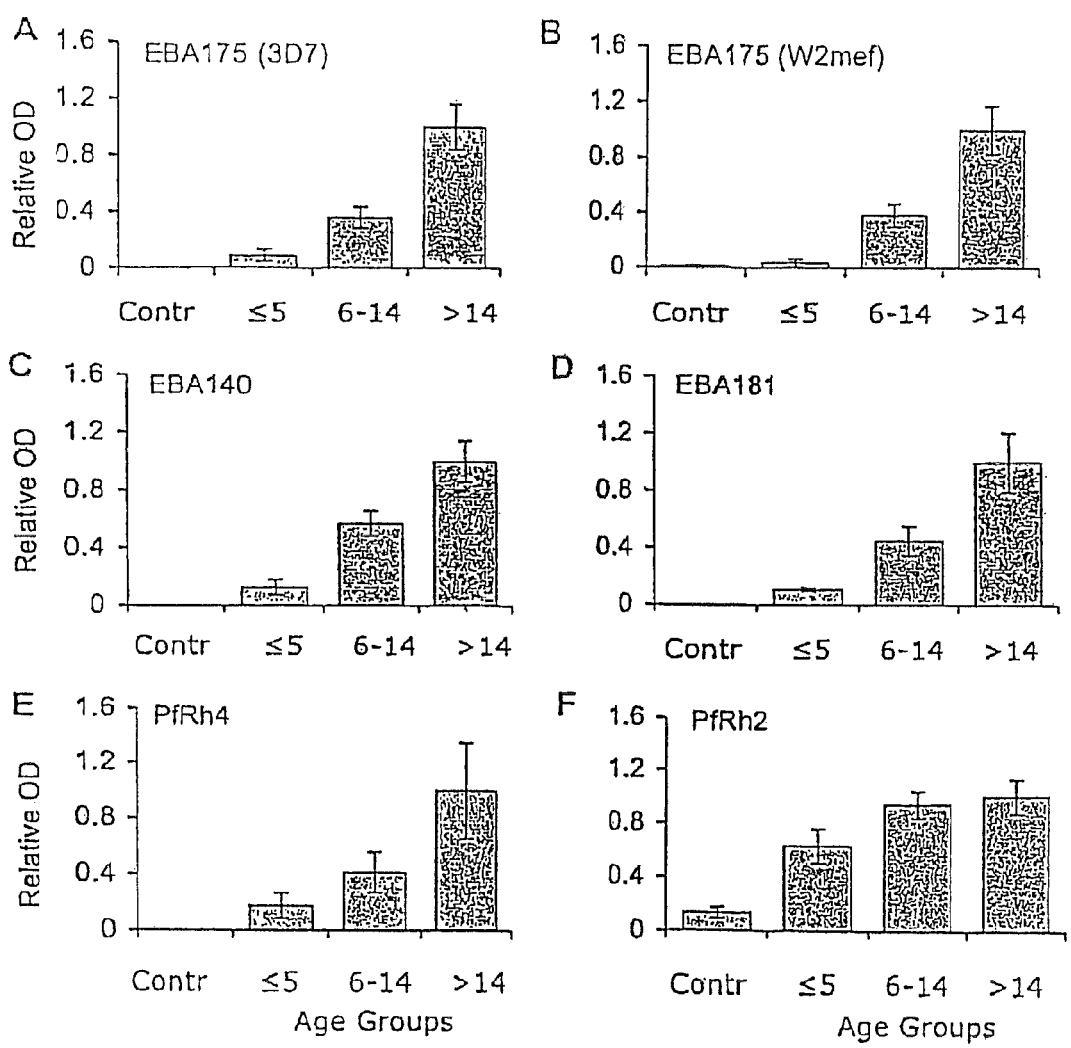

FIG. 6. Age-associated acquisition of antibodies to recombinant EBA and Rh proteins measured by ELISA.

Results (n=150) are grouped by age and show mean±SEM absorbance expressed relative to the levels for adults (>14 years). P<0.001 for comparisons between age groups for all antigens. Donors were residents of a malaria endemic region of Kenya (Kilifi District). The relative absorbance using sera from non-exposed donors (n=10) is also shown (Contr).

FIG. 7. Recombinant Rh4 binds the surface of erythrocytes

A. Schematic representation of *Plasmodium falciparum* Rh4 and recombinant Rh4 proteins. Rh4 is a two exon gene with a transmembrane domain (green) at the C-terminal end. Amino acids 28-766 and amino acids 853-1163 of Rh4 are fused to a hexa-histidine tag (orange) to generate $Rh4_{88}$ and $Rh4_{42}$ respectively. Diagram is not drawn to scale. B. Purification of $Rh4_{88}$. $Rh4_{88}$ was purified using Ni-NTA agarose beads and eluted with 250 mM imidazole buffer. Lane 1 and 2 are expression levels of purified $RH4_{88}$ obtained from two separate bacteria clones. C. $Rh4_{88}$ binds to the surface of erythrocytes. The PBS lane represents the control lane in which proteins were eluted in a binding assay performed in the presence of PBS with no fusion protein. Eluted $RH4_{88}$ is detected using a penta-histidine antibody upon binding to erythrocytes, spun through oil and also upon washing the bound erythrocytes with PBS. D. $Rh4_{42}$ does not bind the surface of erythrocytes. No detection of $Rh4_{42}$ could be observed in the erythrocyte binding assay using a penta-histidine antibody.

FIG. 8. Age-associated acquisition of antibodies to Rh2 measured by ELISA

Results (n=150) are grouped by age and show mean±SEM absorbance expressed relative to the levels for adults (>14 years). P<0.001 for comparisons between age groups for both antigens. Donors were residents of a malaria endemic region of Kenya (Kilifi District). The relative absorbance using sera from non-exposed donors (n=10) is also shown (Melbourne). Antibodies to both amino acids 2098 to 2597 of Rh2 and 2616 to 3115 of Rh2 were detected and acquired in an age-dependent manner.

FIG. 9. Antibodies to Rh2 are associated with protection from malaria among a cohort of 206 children in Madang Province, Papua New Guinea Graphs are Kaplan Meier survival curves. The cumulative proportion (Y-axis) of individuals with symptomatic *Plasmodium falciparum* malaria over time (X-axis) is plotted. Children were classified into three groups on the basis of their antibody response to Rh2: 0=highest tercile of responders (i.e. these children had the highest antibody levels; 1=middle tercile of responders; and 2=lowest tercile of responders (i.e. these children had the lowest levels of antibodies).

A. Children with the highest level of antibodies to PfRh2-A9 (amino acids 2098 to 2597 of Rh2) had the lowest risk of malaria (p<0.01). B. Children with the highest level of antibodies to PfRh2-A11 (amino acids 2616 to 3115 of Rh2) had the lowest risk of malaria (p<0.01).

FIG. 10. Antibodies to EBA are associated with protection from malaria

Graphs are Kaplan Meier survival curves. The cumulative proportion (Y-axis) of individuals with symptomatic *Plasmodium falciparum* malaria over time (x-axis) is plotted.

A. Antibodies to EBA proteins (EBA175, EBA140, and EBA181) by ELISA were associated with reduced risk of clinical malaria. Children were classified into three groups (high, medium, low) on the basis of their antibody response to all three EBAs. Highest responders show lowest risk of malaria, indicating that the breadth and level of antibodies is associated with protection (P<0.01). B, C. D. Children were classified as having high (red) or low (blue) antibody levels and plotted against time to first clinical episode. Those with high antibody levels had a significantly lower risk of malaria (P<0.01).

Figure 11:
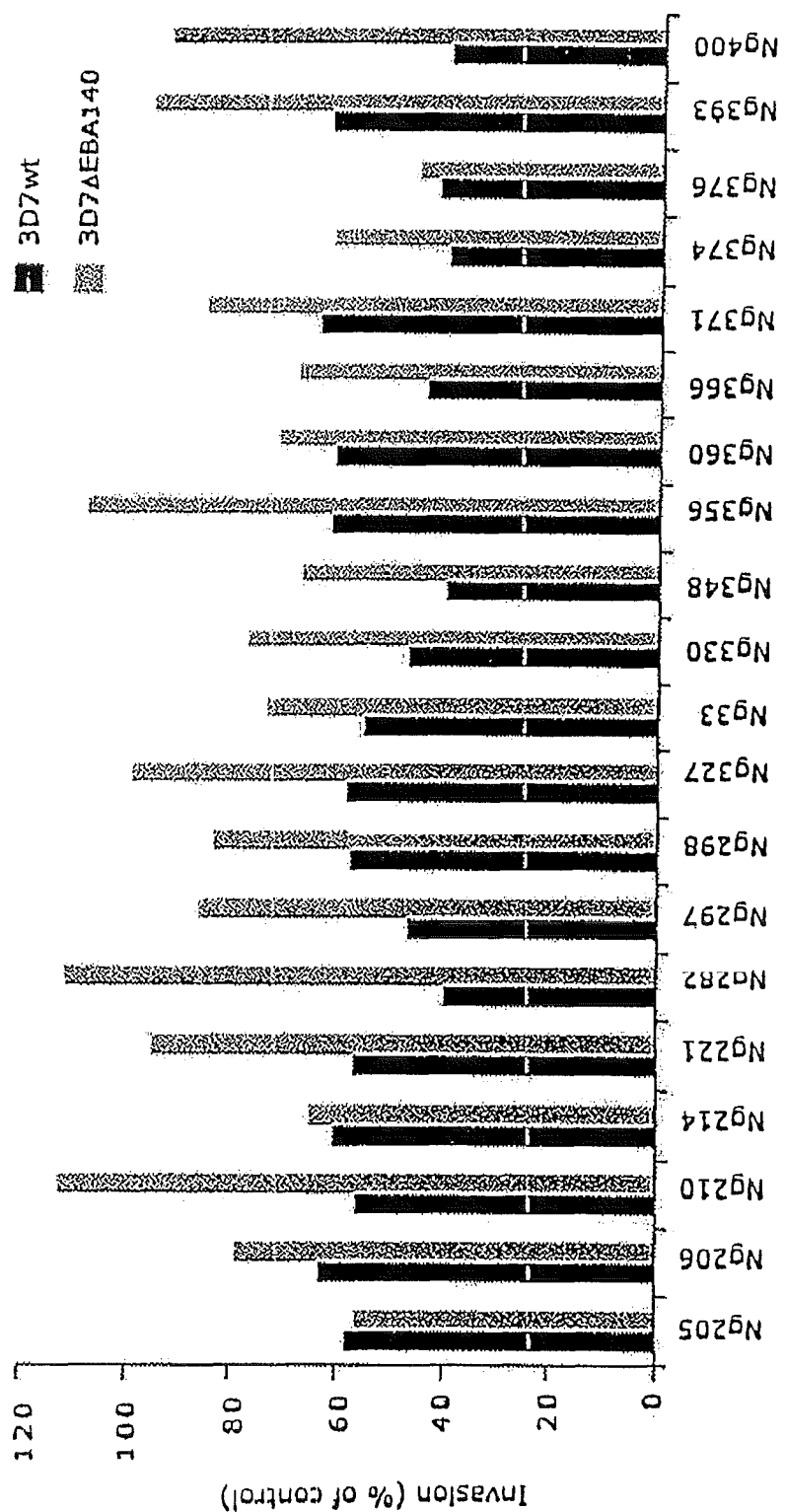

FIG. 11. Differential inhibition of 3D7-wt and 3D7ΔEBA140 by serum antibodies.

A selection of individual samples is shown that inhibit 3D7-wt to a greater extent than 3D7ΔEBA140. This suggests the presence of inhibitory antibodies against EBA140. Values are expressed as a percentage of invasion using non-exposed donors. All samples were tested in duplicate and values represent means.

Figure 12:
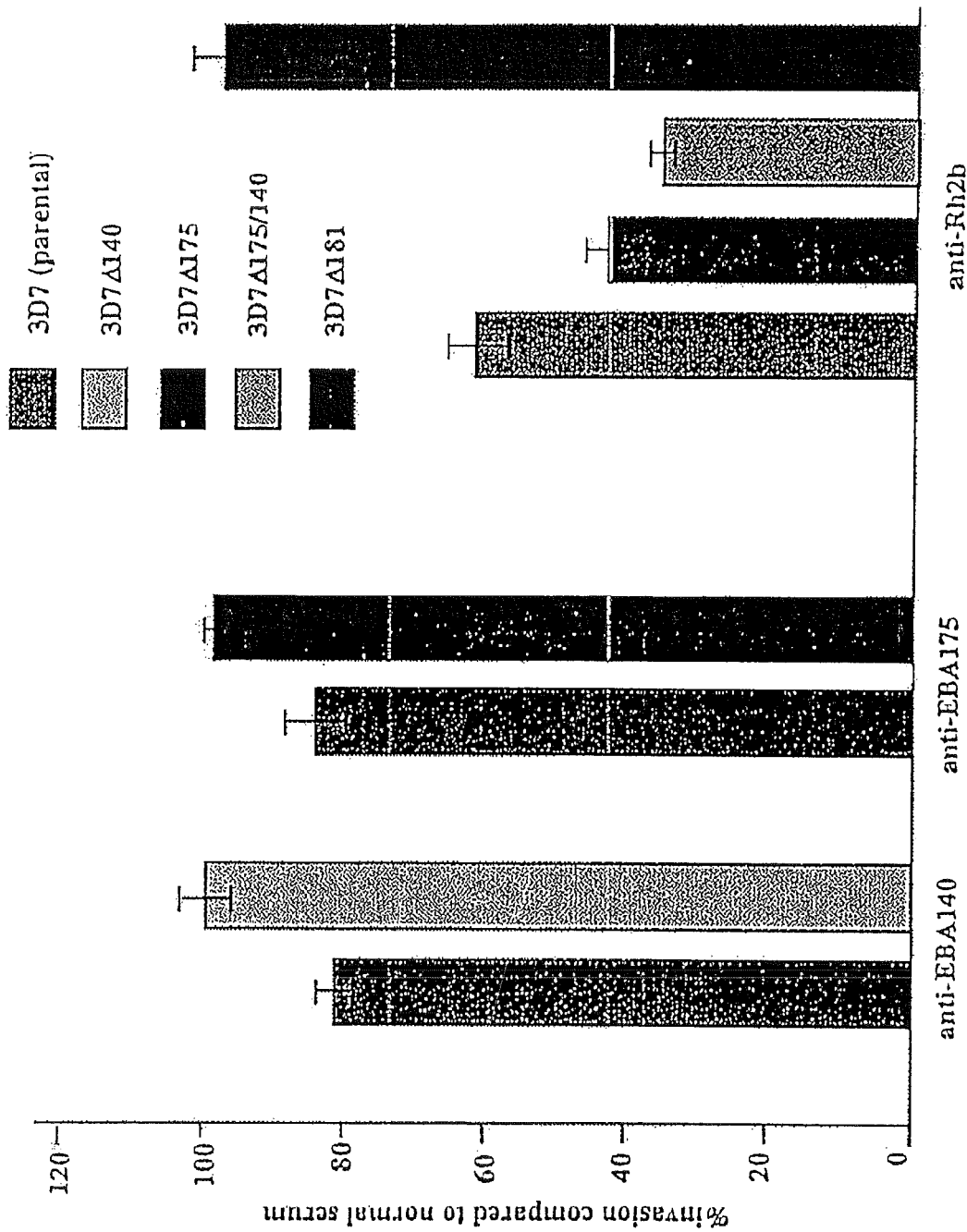

FIG. 12. Inhibition of both SA-dependent and SA-independent invasion pathways (e.g. EBA175, EBA140, EBA181 and Rh2) acts synergistically to inhibit invasion of human erythrocytes.

Antibodies were generated to specific domains of EBA175, EBA140, EBA181 and PfRh2b in rabbits. Protein G purified antibodies (IgG) from these sera were obtained and used to test inhibition of merozoite invasion at 1 mg/ml in wild type 3D7 as well as lines in which the gene encoding different ligands had been disrupted i.e. 3D7Δ175, 3D7Δ140, 3D7Δ175/140 and 3D7Δ181. Anti-EBA140 antibodies inhibited parental 3D7 approximately 20% and this is disappears in 3D7Δ140 as would be expected for specific inhibition of function. Similarly, antibodies to EBA175 inhibit 3D7 merozoite invasion approximately 18% and this does not occur for 3D7Δ175 again showing that function of this ligand is specifically inhibited. Importantly, antibodies targeting Rh2 inhibit invasion of parasites lacking EBA175, or EBA174 and EBA140, to a greater extent than inhibition of wild-type parasites indicating that the SA-dependent and SA-independent invasion pathways are the major pathways of invasion into human erythrocytes, and that inhibition of these two pathways acts to synergistically inhibit invasion.

FIG. 13. PfRh4 is expressed in invasion supernatant and binds the surface of erythrocytes in an enzyme dependent manner.

(A) Western blots of saponin treated schizont pellets (first panel) and invasion supernatants (second panel) were probed with an anti-Rh4 antibody. 3D7, HB3 and W2mefD175 express PfRH4, which is absent from W2mefDRH4. The asterisk, white arrowhead and black arrowhead highlight bands running at 190 kDa, 180 kDa and 160 kDa respectively. (B) Immunodetection of parasite proteins with anti-RH4 and anti-EBA-175 antibodies after binding and elution from untreated and enzyme treated erythrocytes. Lanes begin with the input lane (I), proteins eluted from PBS control (P), untreated erythrocytes (U), neuraminidase (Nm), low trypsin (TL), high trypsin (TH) and chymotrypsin treated erythrocytes. Low trypsin and high trysin are trypsin treatments with 0.1 and 1.5 mg/ml of enzyme respectively. Molecular weight sizes are indicated on the left (in kDa) for both panels.

FIG. 14. PfRH4 binds to the erythrocyte surface through its N-terminal region.

(A) Schematic representation of the various hexa-His tagged fusion proteins made of PfRH4. The C denotes cysteine residues and the black bar represents the transmembrane domain of PfRH4. The numbers below each fusion protein indicate the amino acid sequence that it encompasses. (B) Recombinant Rh4.9 binds erythrocytes in a manner similar to native PfRh4. Immunodetection of recombinant fusion protein with anti-RH4 antibodies after binding and elution from untreated and enzyme treated erythrocytes. Lanes begin with the input lane (I), proteins eluted from PBS control (P), untreated erythrocytes (U), neuraminidase (Nm), low trypsin (TL), high trypsin (TH) and chymotrypsin treated erythrocytes. Low trypsin and high trysin are trypsin treatments with 0.1 and 1.5 mg/ml of enzyme respectively. Molecular weight sizes are indicated on the left (in kDa) for both panels. (C) Minimal binding domain of PfRH4. Binding of recombinant RH4 hexa-His fusion proteins (Rh4.10, 4.11, and 4.13) to untreated erythrocytes were detected using mouse monoclonal anti-pentahis antibodies. Molecular weight sizes are indicated on the left (in kDa).

Figure 15:
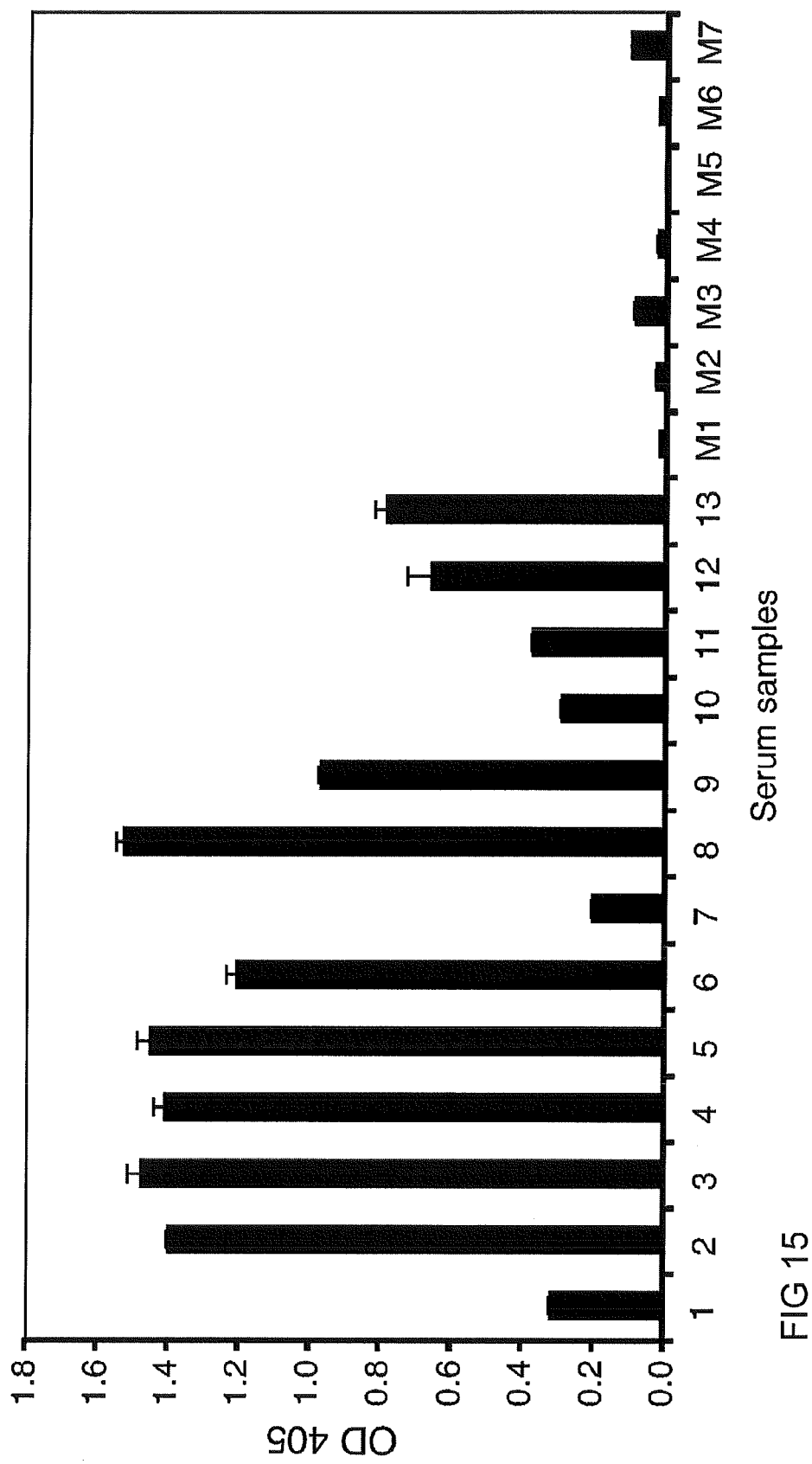

FIG. 15. The relative reactivity of human antibodies to recombinant RH4.9

Reactivity of human total IgG against recombinant Rh4.9 was measured as absorbance (OD405) in an ELISA-based assay. Purified RH4.9 protein was used to coat 96 well plates. Human serum samples were used at a dilution of 1:500. All samples were tested in duplicate and adjusted for background reactivity. Error bars represent the range of two duplicates. Human serum samples are from malaria-exposed adults residing in Madang, Papau New Guinea (numbered samples) and from non-malaria-exposed adults resident in Melbourne, Australia (M1-M8).

Figure 16:
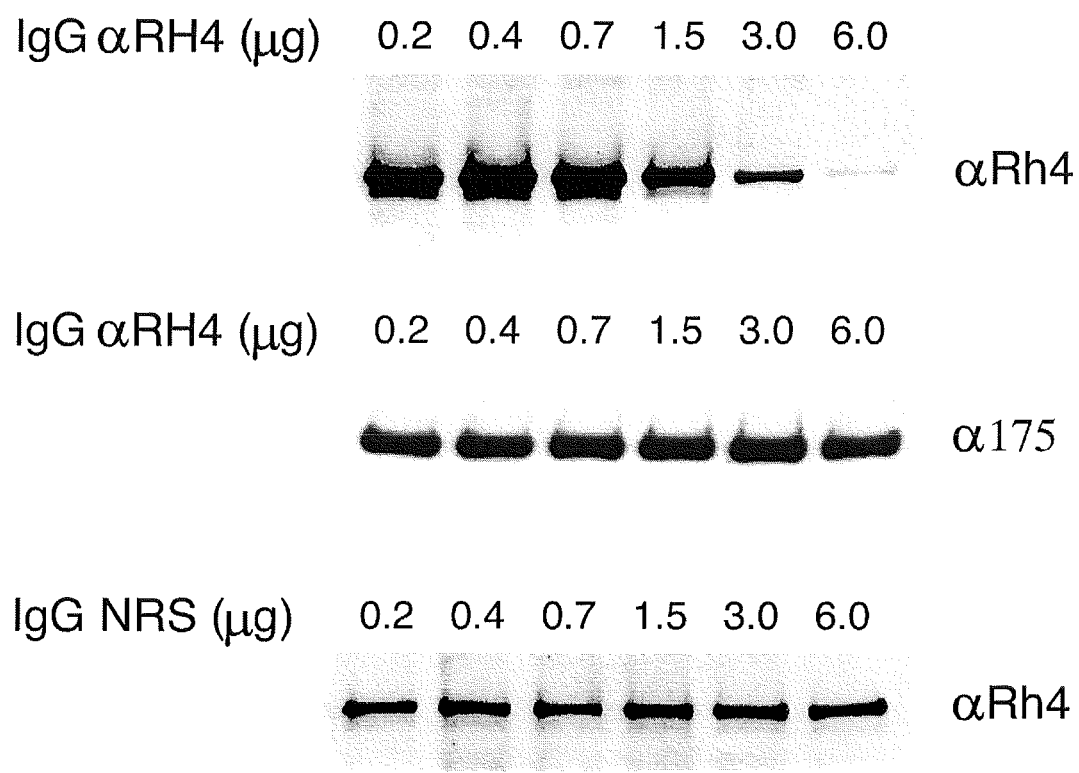

FIG. 16. Antibodies raised to Rh4.9 binding domain inhibit PfRH4 binding to the surface of erythrocytes.

Purified anti-Rh4 IgG antibodies (top and middle panel) and purified normal rabbit serum IgG (bottom panel), at final concentrations of 0.2 to 6 μg, were incubated with 250 μL of 3D7 invasion supernatants prior to the erythrocyte binding assay. Immunodetection of parasite proteins with anti-RH4 antibodies (top and bottom panel) and anti-EBA-175 antibodies (middle panel) after binding and elution from untreated erythrocytes is shown.

Figure 17:
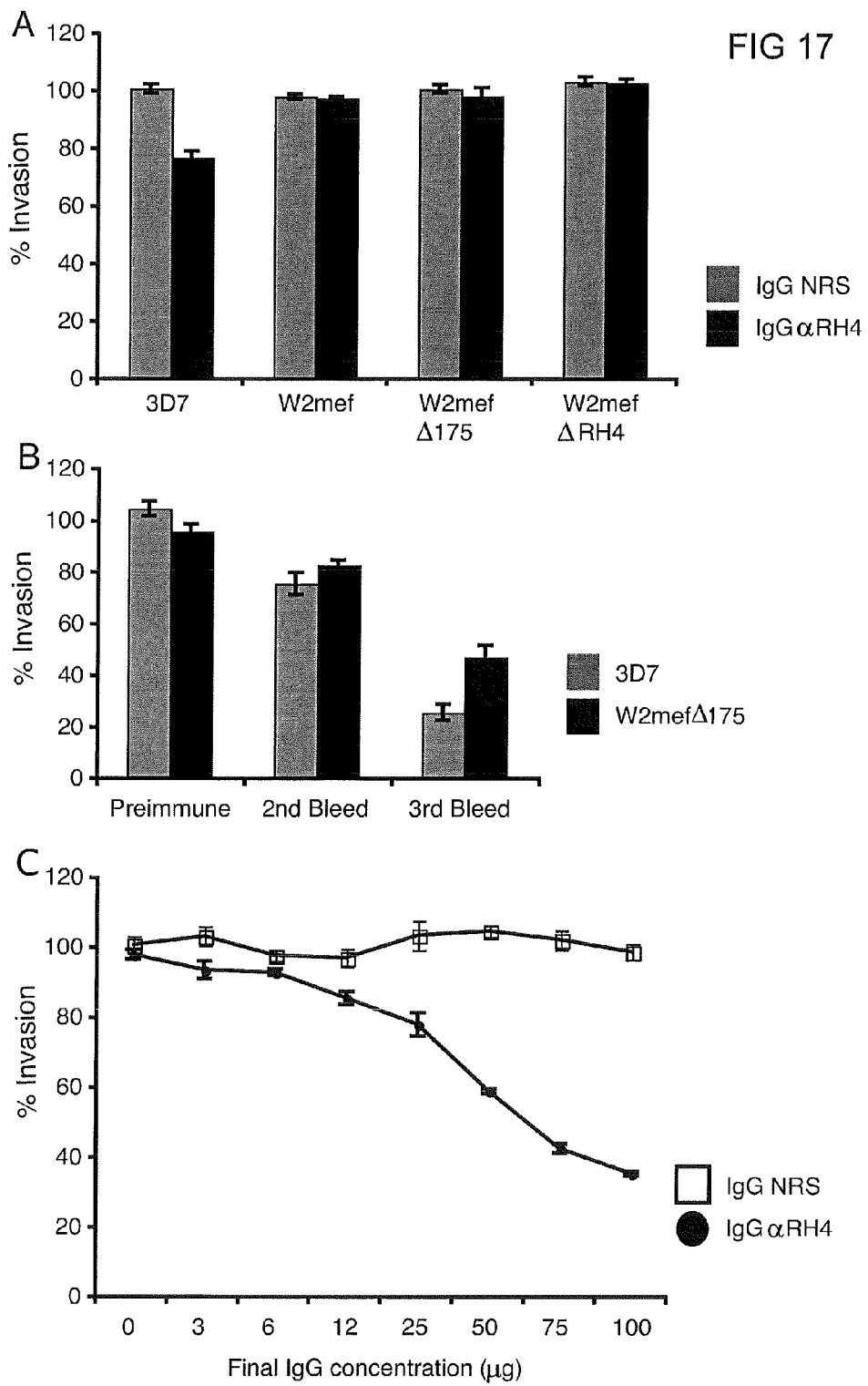

FIG. 17. Strain specific invasion inhibition of parasite growth using PfRH4 antibodies.

A) Data represent parasite growth for the 3D7, W2mef, W2mefΔ175 and W2mefΔRh4 parasite lines grown in the presence of purified IgG from rabbit pre-bleed serum (grey bars) or anti-Rh4 purified IgG antibodies (black bars) using normal (untreated) erythrocytes. B) Growth of the 3D7 (grey bars) and W2mefΔ175 (black bars) lines in the presence of purified IgG from rabbit pre-immune serum, purified Rh4 IgG from 2nd bleed serum and purified IgG from 3rd bleed serum using neuraminidase treated erythrocytes. C) Growth of the 3D7 parasite line in the presence of a dilution series for purified non-specific IgG from rabbit pre-bleed serum (white squares) and purified anti-RH4 IgG antibodies (black circles) using neuraminidase treated erythrocytes shows that Rh4 antibody inhibition of parasite growth is concentration dependant. Final concentrations of IgG antibodies range from 0 to 100 μg in each invasion assay. For all panels, parasite growth is measured as a percentage of the mean parasite growth for four wells with non-specific IgG from rabbit pre-bleed serum control added in each experiment. Error bars represent the standard error of the mean for duplicate wells in two independent experiments.

FIG. 18. Differential protein mobility of PfRH4 in saponin treated schizont pellets and culture supernatants.

(A) Schematic representation of the various domains of PfRH4 to which rabbit polyclonal antibodies were raised to. The black bar above each antibody name (R922, R206, R936) highlights the region of the fusion protein used. The C denotes cysteine residues and the black bar within the schematic represents the transmembrane domain of PfRH4. (B) Western blots of saponin treated schizont pellets and culture supernatants were probed with three separate anti-Rh4 antibodies. The asterisk, white arrowhead and black arrowhead highlight bands running at 190 kDa, 180 kDa and 160 kDa respectively.

Figure 19:
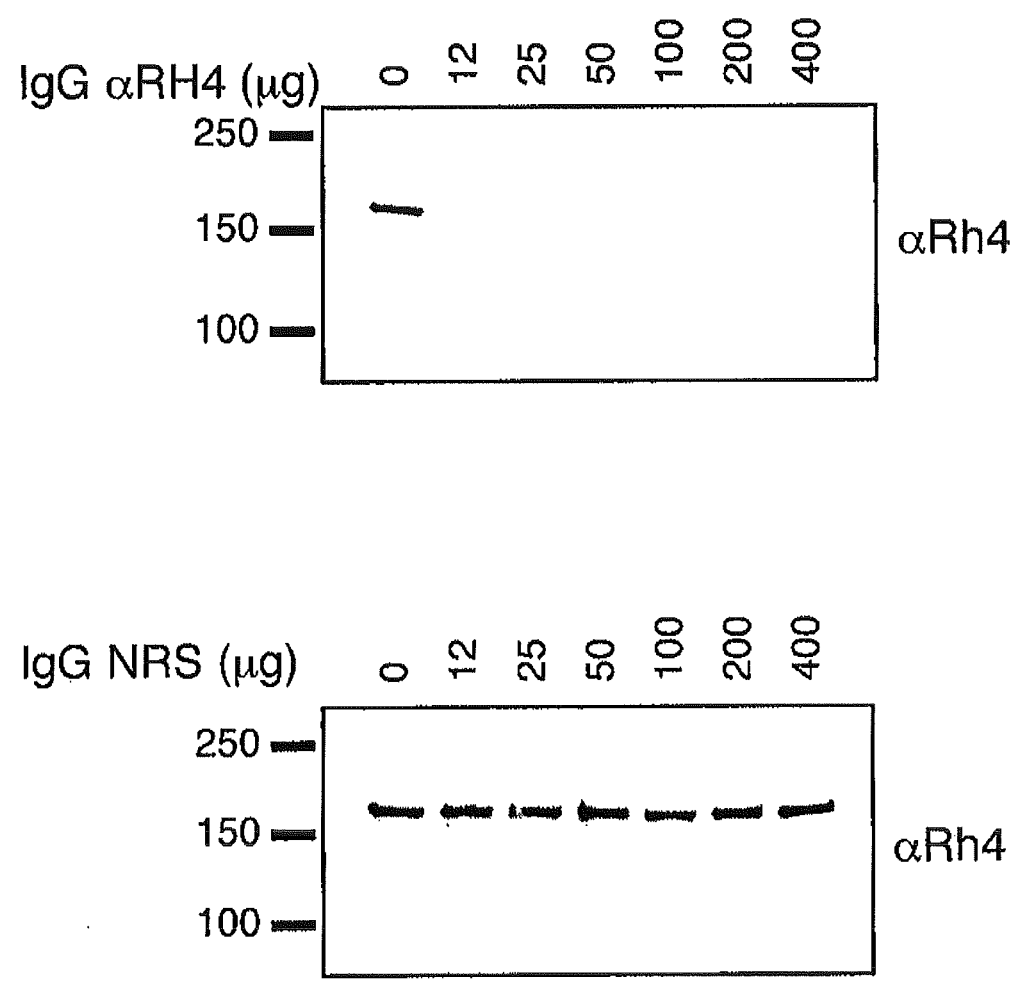

FIG. 19. Antibodies raised to Rh4.9 binding domain inhibit PfRH4 binding to the surface of erythrocytes.

Purified anti-Rh4 IgG antibodies (top panel) and purified normal rabbit serum IgG (bottom panel), at final concentrations of 0 to 400 μg, were incubated with 250 μL of 3D7 invasion supernatants prior to the erythrocyte binding assay. Immunodetection of parasite proteins with anti-RH4 antibodies after binding and elution from untreated erythrocytes is shown. Molecular weight sizes are indicated on the left (in kDa).

Figure 20:
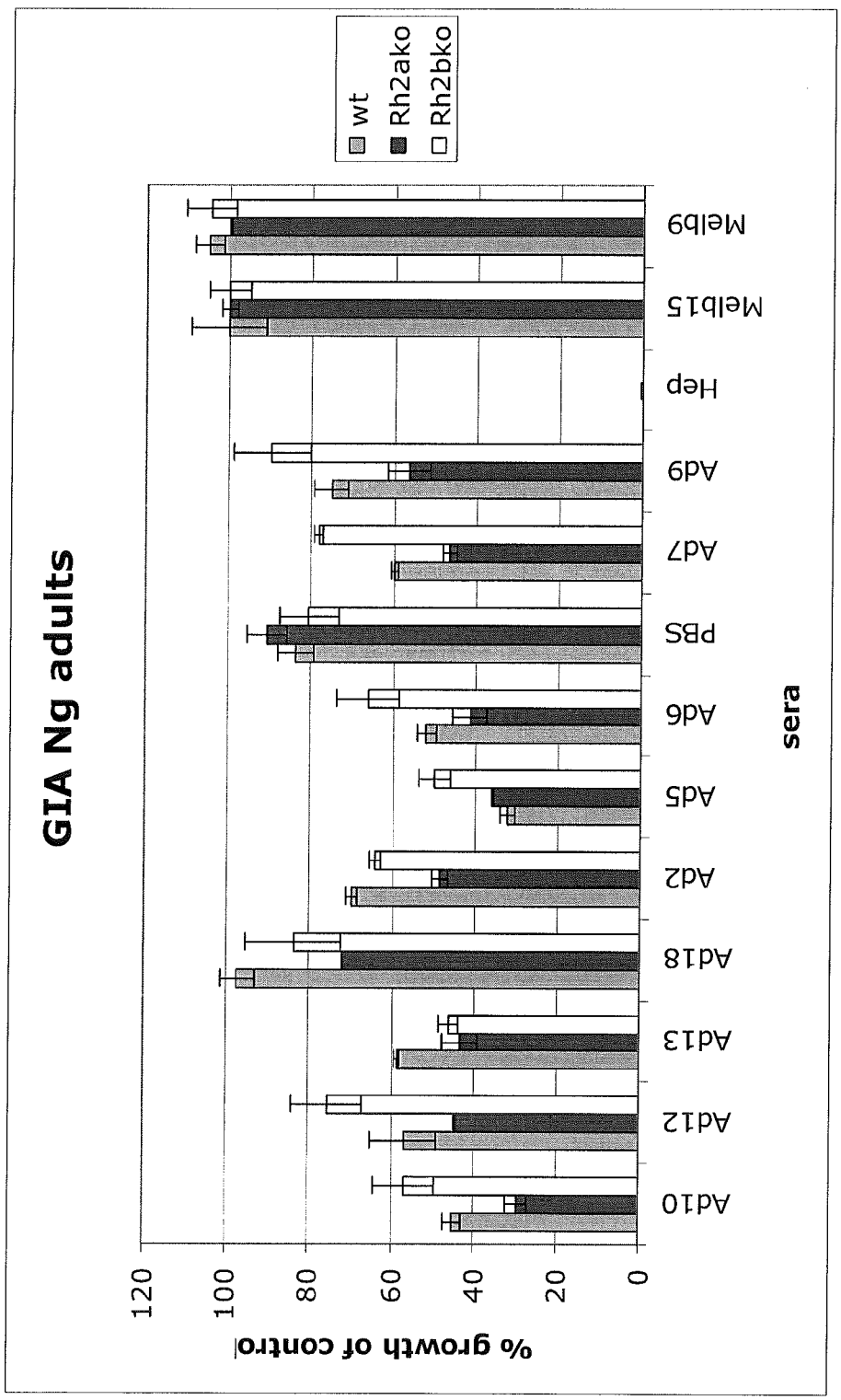

FIG. 20. Inhibition by serum antibodies from adults of the *P. falciparum* line 3D7 wt versus 3D7 with disruption of PfRh2a or PfRh2b Serum antibodies were tested for their ability to inhibit erythrocyte invasion of 3D7-wild type (wt) parasites or 3D7 parasites with disruption of PfRh2a (Rh2aKO) or PfRh2b (Rh2bKO). Serum samples were obtained from Kenyan adults and were dialysed against PBS before use in growth-inhibition assays.

Figure 21:
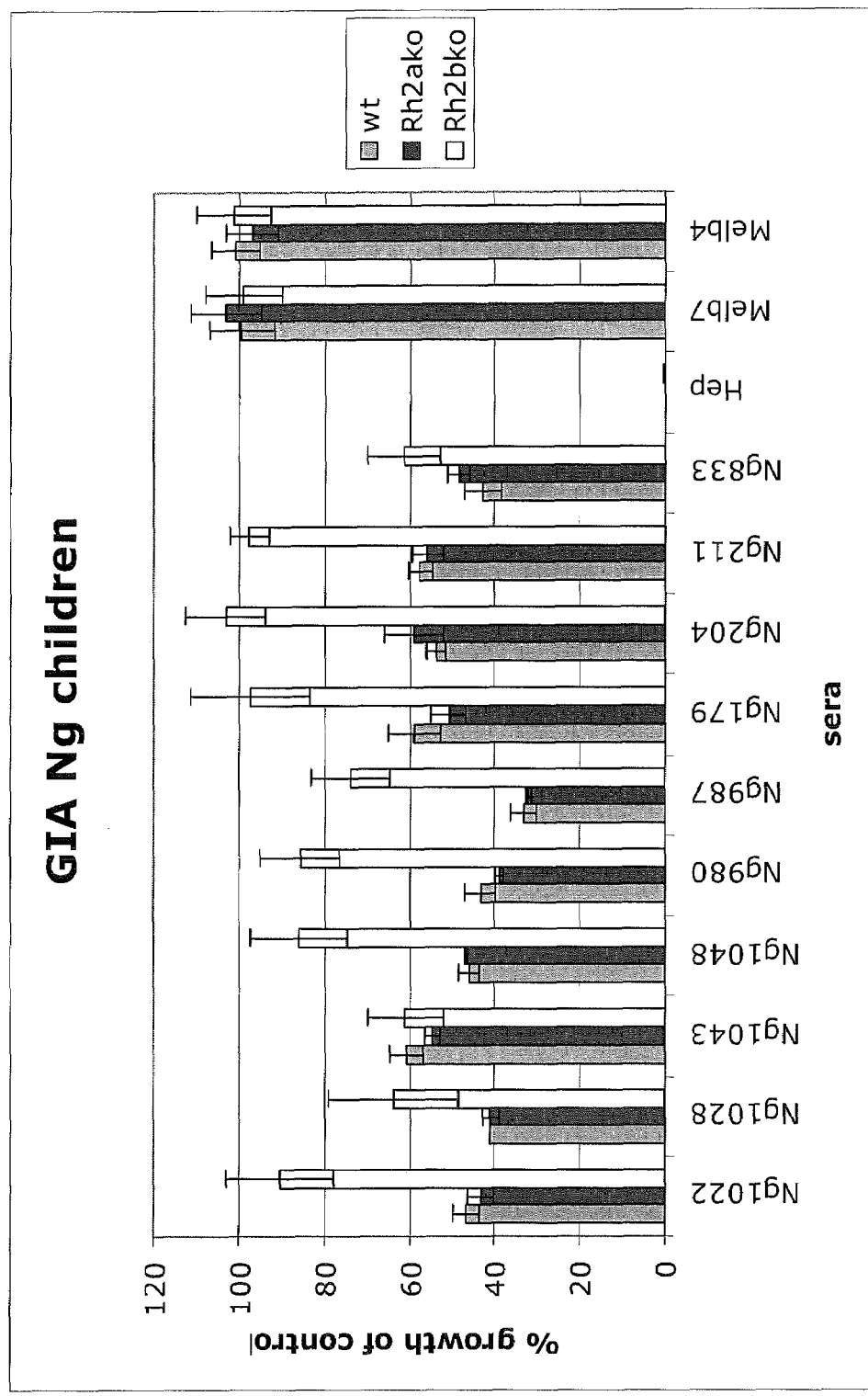

FIG. 21. Inhibition by serum antibodies from children of the *P. falciparum* line 3D7 wt versus 3D7 with disruption of PfRh2a or PfRh2b Serum antibodies were tested for their ability to inhibit erythrocyte invasion of 3D7-wild type parasites (wt) or 3D7 parasites with disruption of PfRh2a (Rh2aKO) or PfRh2b (Rh2bKO) (methods described by Persson et al., J. Clin. Invest. 2008). Serum samples were obtained from Kenyan children and were dialysed before use in growth-inhibition assays.

DETAILED DESCRIPTION OF THE INVENTION

The present invention is predicated on the finding that antibodies raised against erythrocyte binding antigen (EBA) proteins of *Plasmodium falciparum* are capable of inhibiting invasion of the parasite into human red blood cells. The invasion of red blood cells is a key event in the infection of a subject with the malaria parasite, and it is therefore proposed that EBA proteins may be used as antigens in the formulation of a vaccine against malaria. Accordingly, in one aspect, the present invention provides an immunogenic molecule comprising a contiguous amino acid sequence of a erythrocyte binding antigen (EBA) of a strain of *Plasmodium falciparum*, wherein when administered to a subject the molecule is capable of inducing an invasion-inhibitory immune response to the strain. This approach to formulating a vaccine for malaria is distinguished from approaches of the prior art, and is indeed contrary to the general teaching of the prior art prior to the present invention.

Previous work characterizing the function of EBA proteins (and also the reticulocyte-binding protein homologue (Rh) proteins) in human red cell (erythrocyte) invasion by the malaria parasite *Plasmodium falciparum* has demonstrated that these molecules are not essential for red cell invasion since the genes encoding these molecules (e.g. EBA175, EBA140, EBA181, Rh1, Rh2a, Rh2b and Rh4) can be disrupted in different *Plasmodium falciparum* lines without an obvious effect on blood stage growth rates. Also, antibodies raised in rabbits and mice to Rh2a and Rh2b are unable to inhibit invasion of *Plasmodium falciparum* into untreated red cells in vitro, again suggesting that these molecules are not essential for invasion of red cells. Furthermore, recent work examining Rh4 (Gaur et al. (2007) PNAS 104(45):117789) has identified that while antibodies to both native Rh4 and a recombinant protein encoding a region of Rh4 (rRH4$_{30}$) inhibited the binding of these proteins to red cells, the same antibodies failed to block invasion of red cells, causing the authors to conclude that Rh4 is inaccessible for antibody-mediated inhibition of the invasion process. In contrast, the applicants proposal that Rh proteins are capable of eliciting a protective immune response suggests that reticulocyte-binding protein homologues are accessible to the human immune system, that human antibodies to these proteins inhibit invasion of *Plasmodium falciparum* into red cells, and that antibodies to these proteins result in immunity to malaria in humans.

A study by Duraisingh et al. (2003; EMBO J. 22:1047) demonstrated that antibodies to Rh2a and Rh2b are unable to inhibit invasion of *Plasmodium falciparum* into untreated red cells. This work also demonstrated that Rh2a is not expressed by MCAMP, FCB1, T994 or FCR3, and Rh2b, in addition to being absent from D10, is not expressed by MCAMP, FCB1, T994 or FCR3, further suggesting that Rh2a and Rh2b are not essential for invasion of red cells. The growth and merozoite invasion rate of *Plasmodium falciparum* parasites in which the Rh2a and Rh2b genes have been disrupted is unchanged relative to their wild-type parent lines, suggesting that these molecules are not essential for invasion of wild-type parasites into normal erythrocytes. Therefore therapeutics targeting these non-essential invasion pathways would not be expected to be invasion-inhibitory (Duraisingh et al. (2003) EMBO J. 22:1047).

In complete contrast to the findings of the aforementioned authors, the present invention demonstrates that human antibodies to Rh proteins inhibit invasion. FIG. 1 shows that human antibodies to Rh proteins inhibit invasion. The inhibitory activity of serum antibodies from children and adults resident in a malaria endemic region of coastal Kenya was compared against different W2mef and 3D7 parasite lines with different invasion phenotypes. While EBA and Rh proteins are not essential for invasion as discussed above, these molecules play a role in invasion of enzyme treated red cells. In particular, neuraminidase removes sialic acid residues from the erythrocyte surface and blocks invasion pathways dependent on sialic acid present on both glycophorin A and other receptors, trypsin treatment cleaves proteins such as glycophorin A and C, but does not affect glycophorin B, and chymotrypsin cleaves a non-overlapping set of proteins including glycophorin B and band 3 on the erythrocyte surface. Using this approach, invasion phenotypes can be broadly classified into two main groups: i) sialic acid (SA)-dependent invasion, demonstrated by poor invasion of neuraminidase-treated erythrocytes (neuraminidase cleaves SA on the erythrocyte surface), and ii) SA-independent invasion, demonstrated by efficient invasion of neuraminidase-treated erythrocytes, involves Rh2 and Rh4. SA-dependent (neuraminidase-sensitive) invasion of enzyme treated cells involves the three known EBAs (EBA175, EBA181, EBA140), Rh1. EBA175 and EBA140 bind to glycophorin A and C, respectively. EBA181 binds to SA on the erythrocyte surface and to band 4.1 protein. W2mef-wt uses SA-dependent invasion mechanisms (EBA- and Rh1-dependent), whereas invasion of W2mefΔEBA175 is largely SA-independent (Rh2 and Rh4-dependent). In comparative inhibition assays (FIG. 1), 27% of samples differentially inhibited the two lines (e.g. samples 56, 109, and 135 in FIG. 1A), indicating that the inhibitory activity of acquired antibodies is influenced by the invasion pathway being used (FIGS. 1 and 2). Although W2mefΔEBA175 has switched to use a largely SA-independent invasion pathway, it remains possible that other ligands involved in SA-dependent invasion (e.g. EBA140, EBA181, Rh1) may still be functional to some extent in W2mefΔEBA175, despite the switch in phenotype. To inhibit these interactions, and more clearly compare antibodies against SA-dependent versus SA-independent invasion pathways, antibody inhibition assays were performed using W2mefΔEBA175 and neuraminidase-treated erythrocytes, in comparison to inhibition of W2mef-wt with normal erythrocytes (FIG. 2B). This approach further emphasizes differences in antibody activity linked to variation in invasion phenotype. The proportion of samples showing differential inhibition of the two lines was 48% versus 27% when using normal erythrocytes with both lines. The extent of differences in inhibitory activity was strongly increased for some individual samples (e.g. sample 355 in FIG. 3A). This indicates that the inhibitory activity of antibodies against ligands of SA-independent invasion (e.g. Rh2 and Rh4) was enhanced once the residual activity of SA-dependent ligands (e.g. EBA175, EBA140, EBA181 and Rh1) is inhibited by neuraminidase treatment of erythrocytes.

Differential inhibition by samples was also observed with W2mef-wt compared to W2mefSelNm (FIGS. 1B and 2C). The latter isolate is genetically intact and its phenotype was generated by selection for invasion of neuraminidase-treated erythrocytes. Like W2mefΔEBA175, it uses an alternate SA-independent invasion pathway and has upregulated expression of Rh4. It still expresses EBA175 but does not depend on this ligand for invasion. 35% of samples from children and adults were found to differentially inhibit the two lines (e.g. samples 196 and 436, FIG. 1B), confirming that a change in invasion phenotype, or pathway, can substantially alter the efficacy of inhibitory antibodies. As expected, the inhibition of W2mefSelNm and W2mefΔEBA175 by samples was highly correlated (r=0.61; n=80; p<0.001) as these isolates invade via the same pathway and only differ by the presence of EBA175. Antibody dependent inhibition of W2mefSelNm invasion into neuraminidase-treated erythrocytes (FIG. 2D), compared to W2mef-wt in normal erythrocytes, was tested to more clearly evaluate antibodies against SA-independent (Rh2- and Rh4-dependent) versus SA-dependent invasion (EBA- and Rh1-dependent pathways). Overall, 45% of samples differentially inhibited the two lines. Some samples showed greater differences in the inhibition of W2mef-wt and W2mefSelNm than when normal erythrocytes were used (e.g. samples 196 and 436 in FIG. 1B), indicating that human antibodies to SA independent ligands (e.g. Rh2 and Rh4) inhibit invasion. Differential antibody inhibition of 3D7 lines with different invasion phenotypes further confirmed that variation in invasion phenotypes influences the activity of inhibitory antibodies (FIG. 1C and FIGS. 3, A and B). The proportion of samples that differentially inhibited parental 3D7 versus 3D7ΔEBA175 was 26% when using normal erythrocytes and 37% when using neuraminidase-treated erythrocytes with 3D7ΔEBA175. These combined results with W2mef and 3D7 lines clearly established that the availability of alternate pathways for erythrocyte invasion is immunologically important and a mechanism for evasion of acquired invasion-inhibitory antibodies of SA-independent invasion ligands (e.g. Rh2 and Rh4) and SA-dependent ligands (e.g. EBA175, EBA140, EBA181 and Rh1).

Of those samples that differentially inhibited W2mef-wt versus W2mefΔEBA175 (cultured with normal erythrocytes), 26 of 27 inhibited the parental W2mef more than W2mefΔEBA175 (P<0.001; FIG. 2) indicating inhibitory antibodies targeting EBA175 and other ligands of SA-dependent invasion (e.g. EBA140, EBA181 and Rh1). Overall, the mean inhibition of W2mef-wt by all samples (39.4%) was significantly greater than W2mefΔEBA175 (29.4%; p<0.01) (FIG. 2). When W2mefΔEBA175 was cultured with neuraminidase-treated erythrocytes to inhibit any residual SA-dependent interactions, there was an increase in the difference in the mean inhibition of W2mef-wt versus W2mefΔEBA175 by samples (a difference of 18.9% versus 10% using untreated erythrocytes; p<0.01; FIG. 4). Antibodies from 60% of children ≤5 years inhibited W2mef-wt to a greater extent than W2mefΔEBA175 (FIG. 2B) (e.g. inhibiting EBA175, EBA140, EBA181 and Rh1), whereas among adults, 22% showed this pattern of inhibition (p=0.019). Similar to results from assays using W2mefΔEBA175, 31% of samples inhibited W2mef-wt more than W2mefSelNm (Type A response; FIG. 4C), whereas only 4% inhibited W2mefSelNm more than W2mef-wt (p<0.001). Additionally, the mean inhibition of W2mef-wt (39.4%) by all samples was greater than W2mefSelNm (20%; p<0.01) (FIG. 4). Furthermore, serum samples inhibited the invasion of 3D7-wt into normal erythrocytes more than 3D7ΔEBA175 using neuraminidase-treated erythrocytes (FIG. 5B). This indicates the presence of antibodies against the ligands of SA-dependent invasion (EBA17S, EBA140, EBA181 and Rh1). In contrast to W2mef, disruption of EBA175 in 3D7 does not lead to a major switch in invasion phenotype. 3D7ΔEBA175 shows slightly greater resistance to the effect of neuraminidase-treatment of erythrocytes compared to 3D7-wt, and increased sensitivity to inhibition by chymotrypsin-treatment of erythrocytes, consistent with the loss of function of EBA175.

Invasion-inhibitory antibodies to SA-independent invasion ligands (e.g. Rh2 and Rh4) were examined by identifying human serum samples that inhibited W2mefΔEBA175 or 3D7ΔEBA175 more than the corresponding parental parasites. Invasion of W2mefΔEBA175 or 3D7ΔEBA175 into neuraminidase-treated erythrocytes is dependent on ligands of the SA-independent invasion pathway (e.g. Rh2 and Rh4). Using the W2mef line, 5% of samples (FIG. 2B) showed inhibition of ligands of the SA-independent invasion pathway (e.g. Rh2 and Rh4) and inhibited invasion of W2mefΔEBA175 into neuraminidase-treated erythrocytes more effectively than W2mef-wt. Furthermore, 13% inhibited W2mefselNm more than W2mef-wt (e.g. sample 436, FIG. 1B). Inhibition of ligands of the SA-independent invasion pathway (e.g. Rh2 and Rh4) was more prevalent with 3D7 parasite lines than W2mef (p<0.001). A substantial number of samples inhibited 3D7ΔEBA175 more than 3D7-wt (18% of samples when using normal erythrocytes and 16% when using neuraminidase-treated erythrocytes; FIGS. 5, A and B). No children ≤5 years inhibited W2mefΔEBA175 more than W2mef-wt (FIGS. 2, A and B).

Furthermore, antibodies to SA-dependent (EBA175, EBA140, EBA181 and Rh1) and SA-independent invasion pathway ligands (e.g. Rh2 and Rh4) are acquired in an age dependant manner. FIG. 6 shows that antibody levels to EBA175 (both 3D7 and W2mef alleles), EBA140, EBA181, Rh2 and Rh4 were positively associated with increasing age.

As discussed supra the present invention is predicated on the finding that EBA proteins of Plasmodium falciparum are capable of eliciting invasion-inhibitory immune responses in humans. The Duffy-binding like (DBL) proteins include erythrocyte-binding antigen (EBA)175, EBA140 (also known as BAEBL) and EBA181 (also known as JSEBL). Another DBL gene family member, eba165 (also known as PEBL) of Plasmodium falciparum, appears not to be expressed as a functional protein. These proteins are orthologs of DBL proteins identified in Plasmodium vivax. The cysteine-rich dual DBL domains found toward the N-terminus of EBA175 (called F1 and F2 domains) mediates binding to its cognate receptor, and it is likely that similar domains in EBA140 and EBA181 also play receptor-binding roles. C-terminal of a transmembrane domain, is a cytoplasmic tail of the DBL proteins that does not appear to be directly linked to the actin-myosin motor. The structure of Plasmodium falciparum EBA175 is disclosed herein as SEQ ID NOs; 5 and 6. The F1 and F2 domains of EBA175 are at amino acids 158 to 397, and 462 to 710, respectively. The transmembrane domain of EBA175 is located at amino acids 1425 to 1442. The structure of Plasmodium falciparum EBA181 is disclosed herein as SEQ ID NOs; 7 and 8. The F1 and F2 domains of EBA181 are at amino acids 129 to 371, and 433 to 697, respectively. The transmembrane domain of EBA181 is located at amino acids 1488 to 1510. The structure of Plasmodium falciparum EBA140 is disclosed herein as SEQ ID NOs; 9 and 10. The F1 and F2 domains of EBA140 are at amino acids 154 to 405, and 456 to 706, respectively. The transmembrane domain of EBA140 is located at amino acids 1134 to 1153.

As discussed supra the present invention is predicated on the finding that Rh proteins of Plasmodium falciparum are capable of eliciting invasion-inhibitory immune responses in humans. The reticulocyte-binding protein (RBP) proteins were identified as homologs of rhoptry proteins in *Plasmodium yoelii* and *Plasmodium vivax*, *Plasmodium vivax* is a parasite of humans that preferentially invades reticulocytes, and it expresses two homologs of the Py235 PvRBP1 and PvRBP2. These proteins bind to reticulocytes but not normocytes (i.e. erythrocytes), suggesting that they are responsible for the host-cell preference of this species. A 500-amino-acid region that showed homology between the Py235 and PvRBP-2 protein families was used to search the *Plasmodium falciparum* (3D7 parasite) genome sequence databases, identifying five reticulocyte-binding protein homologue (Rh) genes containing the homologous region; Rh1 (RBP1), Rh2a (RBP2a), PfRh2b (RBP2b), and Rh4 (RBP4); a fifth, Rh3 (RBP3), does not appear to be expressed as a protein. Rh2a and Rh2b have a putative signal sequence at the N terminus and a potential transmembrane domain followed by a short cytoplasmic tail at the C terminus, similar to the structures of Py235, PvRBP-1, and PvRBP-2. The structure of *Plasmodium falciparum* Rh2b is disclosed herein as SEQ ID NOs; 1 and 2. The structure of *Plasmodium falciparum* Rh2a is disclosed herein as SEQ ID NOs; 11 and 12. Analysis of Rh2a and Rh2b has identified a region showing homology to the "0045457 Spectrin repeat" domain (SUPERFAMILY Accession: SSF46966) at amino acids 1735 to 1833, and a region showing homology to the "UPF0103 YJR008W C21ORF19-LIKE CEREVISIAE P47085 SACCHAROMYCES CHROMOSOME C2ORF4 PA500009 IPF893" domain (PRODOM Accession: PD006364) at amino acids 2133 to 2259 of Rh2a and amino acids 2058 to 2184 of Rh2b. The transmembrane domain of Rh2a is located at amino acids 3066 to 3088. The transmembrane domain of Rh2b is located at amino acids 3113 to 3135. The structure of *Plasmodium falciparum* Rh4 is disclosed herein as SEQ ID NOs; 3 and 4. Analysis of 164 has identified a region showing homology to the "0044828 MTH1187/YkoF-like" domain (SUPERFAMILY Accession: SSF89957) at amino acids 1031 to 1141. The transmembrane domain of Rh4 is located at amino acids 1627 to 1649. The structure of *Plasmodium falciparum* Rh1 is disclosed herein as SEQ ID NOs; 13 and 14. The transmembrane domain of Rh1 is located at amino acids 2898 to 2920.

As discussed supra, enzyme treatment of red cells has allowed examination of the receptors to which the Rh and DBL proteins bind. In particular, DBL proteins bind erythrocytes in a sialic-acid-dependent manner as neuraminidase treatment of the host cell ablates binding. EBA175 and EBA140 bind to glycophorin A and C, respectively, and while sialic acid on these receptors is essential for binding, the protein backbone is also important for specificity. EBA181 and Rh1 also bind to glycosylated erythrocyte receptors, although their identity is currently unknown. In contrast, there is no evidence that Rh2a directly binds to erythrocytes. Rh2b and Rh4 have been implicated in merozoite invasion since disruption of the corresponding gene causes these parasites to change the receptor they use for invasion on enzyme-treated red cells.

Antibodies that inhibit the growth of blood stage *Plasmodium falciparum* parasites in vitro are found in the sera of some, but not all, individuals living in malaria endemic regions (Marsh, et al (1989) Trans. R. Soc. Trop. Med. Hyg. 83:293, Brown, et al (1982) Nature. 297:591, Brown, et al. (1983) Infect. Immun. 39:1228, Bouharoun-Tayoun, et al. (1990) J. Exp. Med. 172:1633-1641). Inhibitory antibodies are likely to contribute to the clinical immunity observed in highly exposed individuals but their overall significance to protection remains unclear. Inhibitory antibodies may act in a manner that is independent of complement or other cellular mediators and function by preventing invasion of erythrocytes by the extracellular merozoite form of the parasite. A role for invasion-inhibitory antibodies in immunity to malaria has not been previously demonstrated. One practical reason for this is that there has been a lack of robust in vitro inhibition assays that account for confounding factors present in serum that can cause non-specific inhibitory, or indeed growth-promoting, effects. Although in vitro inhibition assays have been used for some time to assess antibodies to *Plasmodium falciparum* merozoite antigens and have provided a useful guide as to the inhibitory activity of a particular serum or monoclonal antibody, the problems associated with accurate quantification of this activity, especially in whole serum, are well recognized in the field. This problem has now been overcome with the development of an assay that allows accurate quantification of molecule-specific inhibitory antibodies in whole serum. This assay involves a comparison of the inhibitory effect of a given serum on two isogenic parasite lines that differ only in the gene (or genes) of interest. Using this assay, the invasion-inhibitory activity of antibodies present in serum obtained from adults that are clinically immune to malaria may be determined.

The present invention requires that the immunogenic molecule is capable of inducing an invasion-inhibitory immune response in the subject. As used herein, the term "invasion-inhibitory" is intended to include the complete prevention of invasion of an invasion-competent erythrocyte for the lifespan of the subject. The term is also intended to include the partial prevention of invasion, as measured by for example, the proportion of a population of invasion-competent erythrocytes that are invaded, the number of attempts by which it is necessary for a given parasite to invade an erythrocyte, the time taken for a parasite to invade an erythrocyte, and the number of parasites required to ensure that a single erythrocyte is invaded. The complete or partial inhibition of invasion may be for a short period of time (such as several hours), an intermediate period of time (such as weeks, or months), or a protracted period of time (such as years or decades). The inhibition of invasion may be measured in vivo or in vitro.

For the avoidance of doubt, the term "invasion" is intended to include the entire invasion process such that the complete parasite enters the cytoplasm, and is completely encircled by the cytoplasm. The term also includes components of the entire invasion process such as the binding of the parasite to the surface of the erythrocyte, the reorientation of the apical end of the parasite to contact the erythrocyte surface, entry of the parasite into a parasitophorous vacuole, release of protein from apical organelles, and the shedding of parasite surface protein by proteases. Furthermore, the term "invasion" includes both SA dependent and SA-independent invasion pathways. Immune responses to these pathways are known as type-A and type-B inhibitory responses, respectively.

The present invention includes immunogenic molecules capable of eliciting an immune response against a wild-type strain of *P. falciparum*, or any of the following strains: 3D7, W2MEF, GHANA1, V1_S, RO-33, PREICH, HB3, SANTA-LUCIA, 7G8, SENEGAL3404, FCC-2, K1, RO-33, D6, DD2, or D10, or any other known or newly isolated strain of *Plasmodium falciparum*. An isolate or strain of *Plasmodium falciparum* is a sample of parasites taken from an infected individual on a unique occasion. Typically, an isolate is uncloned, and may therefore contain more than one genetically distinct parasite clone. A *Plasmodium falciparum* line is a lineage of parasites derived from a single isolate, not necessarily cloned, which have some common phenotype (e.g. drug-resistance, ability to invade enzyme treated red cells etc.). A *Plasmodium falciparum* clone is the progeny of a single parasite, normally obtained by manipulation or serial dilution of uncloned parasites and then maintained in the laboratory. All the members of a clone have been classically defined as genetically identical, but this is not necessarily the case, since members of the clone may undergo mutations, chromosomal rearrangements, etc, which may survive in in vitro culture conditions. While the immunogenic molecule will typically include amino acid sequences found in an Rh protein of the strain for which protection is desired, this is not necessarily required.

Typically, the immunogenic molecule is a polypeptide, or includes a polypeptide region. As used herein, the term "polypeptide" refers to amino acid polymers of any length. The polymer may be linear or branched, it may comprise modified amino acids, and it may be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included are, for example, polypeptides containing one or more analogs of an amino acid (including, for example, unnatural amino acids, etc.), as well as other modifications known in the art. Polypeptides can occur as single chains or associated chains.

In one form of the immunogenic molecule, the EBA molecule is EBA175 (PlasmoDB Accession No: MAL7P1.176), and the contiguous amino acid sequence is found in SEQ ID NO: 5:

```
MKCNISIYFFASFFVLYFAKARNEYDIKENEKFLDVYKEKFNELDKKKYGNVQKTDKKIF

TFIENKLDILNNSKFNKRWKSYGTPDNIDKNMSLINKHNNEEMFNNNYQSFLSTSSLIKQ

NKYVPINAVRVSRILSFLDSRINNGRNTSSNNEVLSNCREKRKGMKWDCKKKNDRSNYVC

IPDRRIQLCIVNLSIIKTYTKETMKDHFIEASKKESQLLLKKNDNKYNSKFCNDLKNSFL

DYGHLAMGNDMDFGGYSTKAENKIQEVFKGAHGEISEHKIKNFRKKWWNEFREKLWEAML

SEHKNNINNCKNIPQEELQITQWIKEWHGEFLLERDNRSKLPKSKCKNNTLYEACEKECI

DPCMKYRDWIIRSKFEWHTLSKEYETQKVPKENAENYLIKISENKNDAKVSLLLNNCDAE

YSKYCDCKHTTTLVKSVLNGNDNTIKEKREHIDLDDFSKFGCDKNSVDTNTKVWECKKPY

KLSTKDVCVPPRRQELCLGNIDRIYDKNLLMIKEHILAIAIYESRILKRKYKNKDDKEVC

KIINKTFADIRDIIGGTDYWNDLSNRKLVGKINTNSNYVHRNKQNDKLFRDEWWKVIKKD

VWNVISWVFKDKTVCKEDDIENIPQFFRWFSEWGDDYCQDKTKMIETLKVECKEKPCEDD

NCKRKCNSYKEWISKKKEEYNKQAKQYQEYQKGNNYKMYSEFKSIKPEVYLKKYSEKCSN

LNFEDEFKEELHSDYKNKCTMCPEVKDVPISIIRNNEQTSQEAVPEESTEIAHRTETRTD

ERKNQEPANKDLKNPQQSVGENGTKDLLQEDLGGSRSEDEVTQEFGVNHGIPKGEDQTLG

KSDAIPNIGEPETGISTTEESRHEEGHNKQALSTSVDEPELSDTLQLHEDTKENDKLPLE

SSTITSPTESGSSDTEETPSISEGPKGNEQKKRDDDSLSKISVSPENSRPETDAKDTSNL

LKLKGDVDISMPKAVIGSSPNDNINVTEQGDNISGVNSKPLSDDVRPDKNHEEVKEHTSN

SDNVQQSGGIVNMNVEKELKDTLENPSSSLDEGKAHEELSEPNLSSDQDMSNTPGPLDNT

SEETTERISNNEYKVNEREGERTLTKEYEDIVLKSHMNRESDDGELYDENSDLSTVNDES

EDAEAKMKGNDTSEMSHNSSQHIESDQQKNDHKTVGDLGTTHVQNEISVPVTGEIDEKLR

ESKESKIHKAEEERLSHTDIHKINPEDRNSNTLHLKDIRNEENERHLTNQNINISQERDL

QKHGFHTMNNLHGDGVSERSQINHSHHGNRQDRGGNSGNVLNMRSNNNNFNNIPSRYNLY

DKKLDLDLYENRNDSTTKELIKKLAEINKCENEISVKYCDHMIHEEIPLKTCTKEKTRNL

CCAVSDYCMSYFTYDSEEYYNCTKREFDDPSYTCFRKEAFSSMPYYAGAGVLFIILVILG

ASQAKYQRLEKINKNKIEKNVN
```

The nucleotide sequence of EBA181 (PlasmoDB Accession No: PFA0125c) is given below (SEQ ID NO: 7)

MKGKMNMCLFFFYSILYVVLCTYVLGISEEYLKERPQGLNVETNNNNNNNNNNNNSNSNDA
MSFVNEVIRFIENEKDDKEDKKVKIISRPVENTLHRYPVSSFLNIKKYGRKGEYLNRNSF
VQRSYIRGCKGKRSTHTWICENKGNNNICIPDRRVQLCITALQDLKNSGSETTDRKLLRD
KVFDSAMYETDLLWNKYGFRGFDDFCDDVKNSYLDYKDVIFGTDLDKNNISKLVEESLKR
FFKKDSSVLNPTAWWRRYGTRLWKTMIQPYAHLGCRKPDENEPQINRWILEWGKYNCRLM
KEKEKLLTGECSVNRKKSDCSTGCNNECYTYRSLINRQRYEVSILGKKYIKVVRYTIFRR
KIVQPDNALDFLKLNCSECKDIDFKPFFEFEYGKYEEKCMCQSYIDLKIQFKNNDICSFN
AQTDTVSSDKRFCLEKKEFKPWKCDKNSFETVHHKGVCVSPRRQGFCLGNLNYLLNDDIY
NVHNSQLLIEIIMASKQEGKLLWKKHGTILDNQNACKYINDSYVDYKDIVIGNDLWNDNN
SIKVQNNLNLIFERNFGYKVGRNKLFKTIKELKNVWWILNRNKVWESMRCGIDEVDQRRK
TCERIDELENMPQFFRWFSQWAHFFCKEKEYWELKLNDKCTGNNGKSLCQDKTCQNVCTN
MNYWTYTRKLAYEIQSVKYDKDRKLFSLAKDKNVTTFLKENAKNCSNIDFTKIFDQLDKL
FKERCSCMDTQVLEVKNKEMLSIDSNSEDATDISEKNGEEELYVNHNSVSVASGNKEIEK
SKDEKQPEKEAKQTNGTLTVRTDKDSDRNKGKDTATDTKNSPENLKVQEHGTNGETIKEE
PPKLPESSETLQSQEQLEAEAQKQKQEEEPKKKQEEEPKKKQEEEQKREQEQKQEQEEEE
QKQEEEQQIQDQSQSGLDQSSKVGVASEQNEISSGQEQNVKSSSPEVVPQETTSENGSSQ
DTKISSTEPNENSVVDRATDSMNLDPEKVHNENMSDPNTNTEPDASLKDDKKEVDDAKKE
LQSTVSRIESNEQDVQSTPPEDTPTVEGKVGDKAEMLTSPHATDNSESESGLNPTDDIKT
TDGVVKEQEILGGGESATETSKSNLEKPKDVEPSHEISEPVLSGTTGKEESELLKSKSIE
TKGETDPRSNDQEDATDDVVENSRDDNNSLSNSVDNQSNVLNREDPIASETEVVSEPEDS
SRIITTEVPSTTVKPPDEKRSEEVGEKEAKEIKVEPVVPRAIGEPMENSVSVQSPPNVED
VEKETLISENNGLHNDTHRGNISEKDLIDIHLLRNEAGSTILDDSRRNGEMTEGSESDVG
ELQEHNFSTQQKDEKDFDQIASDREKEEIQKLLNIGHEEDEDVLKMDRTEDSMSDGVNSH
LYYNNLSSEEKMEQYNNRDASKDREEILNRSNTNTCSNEHSLKYCQYMERNKDLLETCSE
DKRLHLCCEISDYCLKFFNPKSIEYFDCTQKEFDDPTYNCFRKQRFTSMHYIAGGGIIAL
LLFILGSASYRKNLDDEKGFYDSNLNDSAFEYNNNKYNKLPYMFDQQINVVNSDLYSEGI
YDDTTTF

The sequence of EBA 140 (PlasmoDB Accession No: MAL13P1.60) is provided below (SEQ ID NO: 9)

MKGYFNIYFLIPLIFLYNVIRINESIIGRTLYNRQDESSDISRVNSPELNNNHKTNIYDS
DYEDVNNKLINSFVENKSVKKKRSLSFINNKTKSYDIIPPSYSYRNDKFNSLSENEDNSG
NTNSNNFANTSEISIGKDNKQYTFIQKRTHLFACGIKRKSIKWICRENSEKITVCVPDRK
IQLCIANFLNSRLETMEKFKEIFLISVNTEAKLLYNKNEGKDPSIFCNELRNSFSDFRNS
FIGDDMDFGGNTDRVKGYINKKFSDYYKEKNVEKLNNIKKEWWEKNKANLWNHMIVNHKG
NISKECAIIPAEEPQINLWIKEWNENFLMEKKRLFLNIKDKCVENKKYEACFGGCRLPCS
SYTSFMKKSKTQMEVLTNLYKKKNSGVDKNNFLNDLFKKNNKNDLDDFFKNEKEYDDLCD
CRYTATIIKSFLNGPAKNDVDIASQINVNDLRGFGCNYKSNNEKSWNCTGTFTNKFPGTC
EPPRRQTLCLGRTYLLHRGHEEDYKEHLLGASIYEAQLLKYKYKEKDENALCSIIQNSYA

-continued
```
DLADIIKGSDIIKDYYGKKMEENLNKVNKDKKRNEESLKIFREKWWDENKENVWKVMSAV

LKNKETCKDYDKFQKIPQFLRWFKEWGDDFCEKRKEKIYSFESFKVECKKKDCDENTCKN

KCSEYKKWIDLKKSEYEKQVDKYTKDKNKKMYDNIDEVKNKEANVYLKEKSKECKDVNFD

DKIFNESPNEYEDMCKKCDEIKYLNEIKYPKTKHDIYDIDTFSDTFGDGTPISINANINE

QQSGKDTSNTGNSETSDSPVSHEPESDAAINVEKLSGDESSSETRGILDINDPSVTNNVN

EVHDASNTQGSVSNTSDITNGHSESSLNRTTNAQDIKIGRSGNEQSDNQENSSHSSDNSG

SLTIGQVPSEDNTQNTYDSQNPHRDTPNALASLPSDDKINEIEGFDSSRDSENGRGDTTS

NTHDVRRTNIVSERRVNSHDFIRNGMANNNAHHQYITQIENNGIIRGQEESAGNSVNYKD

NPKRSNFSSENDHKKNIQEYNSRDTKRVREEIIKLSKQNKCNNEYSMEYCTYSDERNSSP

GPCSREERKKLCCQISDYCLKYFNFYSIEYYNCIKSEIKSPEYKCFKSEGQSSIPYFAAG

GILVVIVLLLSSASRMGKSNEEYDIGESNIEATFEENNYLNKLSRIFNQEVQETNISDYS

EYNYNEKNMY
```

In one form of the composition, where the EBA is EBA175 the contiguous amino acid sequence is found in SEQ ID NO: 5. The scope of the invention includes mutations of the sequence described in SEQ ID NO: 5. Preferably, mutations for EBA175 include N at amino acid 157 replaced with S, E at amino acid 274 replaced with K, K at amino acid 279 replaced with E, K at amino acid 286 replaced with E, D at amino acid 336 replaced with Y, K at amino acid 388 replaced with N, P at amino acid 390 replaced with S, E at amino acid 403 replaced with K, K at amino acid 448 replaced with E, K at amino acid 478 replaced with N K at amino acid 481 replaced with I, N at amino acid 577 replaced with K, Q at amino acid 584 replaced with K, R at amino acid 664 replaced with S, S at amino acid 768 replaced with N, E at amino acid 923 replaced with K, K at amino acid 932 replaced with E, E at amino acid 1058 replaced with V, or G at amino acid 1100 replaced with D.

In one form of the composition, where the EBA is EBA181 the contiguous amino acid sequence is found in SEQ ID NO: 7. The scope of the invention includes mutations of the sequence described in SEQ ID NO: 7. Preferably, mutations for EBA181 include the V at amino acid 64 replaced with L, Q at amino acid 364 replaced with H, V at amino acid 363 replaced with D, R at amino acid 358 replaced with K, N at amino acid 414 replaced with I, K at amino acid 443 replaced with Q, P at amino acid 878 replaced with Q, E at amino acid 884 replaced with Q, E at amino acid 1885 replaced with K, Q at amino acid 890 replaced with E, P at amino acid 1197 replaced with L, K at amino acid 1219 replaced with N, D at amino acid 1433 replaced with Y or N, or K at amino acid 1518 replaced with E.

In one form of the composition where the EBA is EBA140 the contiguous amino acid sequence is found in SEQ ID NO:9. Preferably, mutations for EBA140 include the V at amino acid 19 replaced with I, L at amino acid 112 replaced with F, I at amino acid 185 replaced with V, N at amino acid 239 replaced with S, K at amino acid 261 replaced with T.

In another form of the composition, where the contiguous amino acid sequence of the EBA protein is found in the region between the F2 domain and the transmembrane domain of the EBA protein. More particularly, the contiguous amino acid sequence may be found in the region from about residue 746 to about residue 1339 of the EBA protein.

In one form of the composition, where the EBA is EBA140 the contiguous amino acid sequence is found in the region from about residue 746 to about residue 1045 of EBA140.

Where the EBA is EBA175 the contiguous amino acid sequence is found in the region from about residue 761 to about residue 1271 of EBA175. Where the EBA is EBA181 the contiguous amino acid sequence is found in the region from about residue 755 to about residue 1339 of EBA181.

As for the EBA protein, in one form of the immunogenic molecule, the contiguous amino acid sequence of the EBA protein comprises about 5 or more amino acids. In another form, the contiguous amino acid sequence molecule comprises about 8, 10, 20, 50, or 100 amino acids. The skilled person is capable of routine experimentation designed to identify the shortest efficacious sequence, or the length of sequence that provides the greatest or most effective invasion-inhibitory response in the subject.

Applicant proposes that Rh4 may be involved in invasion using the SA-independent pathway in enzyme treated red cells, and that inhibiting Rh4-mediated invasion is important in treating or preventing infection. However, recent data (Gaur et al. PNAS in press) has suggested that a region of Rh4 known as rRH4$_{30}$ (comprising amino acids 328 to 588 of Rh4) and native Rh4 bind strongly to neuraminidase treated erythrocytes. Importantly this work demonstrated that while antibodies to the region of Rh4 encoded by amino acids 328 to 588 block binding of the native protein to red cells, these antibodies fail to block invasion, leading the authors to conclude that Rh4 is inaccessible for antibody-mediated inhibition of the invasion process. The authors propose that this inaccessibility may be explained by Rh4 being released after formation of the tight junction during invasion, and consequently antibodies have no access, or the receptor may form the junction too rapidly following merozoite attachment such that interaction with the antibody is not possible. The authors conclude that Rh4 will probably not be an effective candidate in vaccine development.

In contrast, the present invention provides that Rh4 is an effective target of the immune response in humans. FIG. 7C shows that an 88 kDa region of Rh4 of *Plasmodium falciparum* strain 3D7 binds to erythrocytes (amino acids 28 to 766 of Rh4; e.g. amino acids 28 to 766 of SEQ ID NO: 3), whereas a 42 kDa region of Rh4 (amino acids 853 to 1163) is unable to bind erythrocytes. This is consistent with recent work demonstrating that a region of Rh4 (rRh4$_{30}$; amino acids 328 to 588) is able to bind to enzyme treated red cells (Gaur et al. PNAS in press). However, Gaur et al demonstrate that while rRh4$_{30}$ is able to block invasion of *Plasmodium falciparum* strain Dd2 into neuraminidase treated red cells, rRh4$_{30}$ does not block invasion of *Plasmodium falciparum* strain 3D7 into neuraminidase treated red cells. Furthermore, rRh4$_{30}$ is unable to block invasion of untreated red cells, and antibodies to Rh4 fail to block red cell invasion. In contrast, the present invention demonstrates that Rh proteins (including Rh4) are targets of acquired antibodies that inhibit invasion (FIGS. 1B, and C, FIGS. 2 A and B, FIGS. 3 A and B, FIG. 6E). In combination with the differential inhibition of parasite lines that vary in their invasion phenotype, but not genotype, suggests that members of the EBA and Rh proteins may therefore be effective candidates for vaccine development.

To examine the acquisition of invasion-inhibitory antibodies observed in serum samples from children and adults resident in the Kilifi District, Kenya, in 1998 (a year that was preceded with a relatively high incidence of malaria in the region) (EXAMPLES 1 to 7) (FIGS. 1 to 5), recombinant Rh and EBA proteins were utilized (FIG. 6). Human antibodies to EBA175 were detected (FIGS. 6A and B) in the serum samples used to identify invasion-inhibitory antibodies (FIGS. 1 to 5). In particular, antibodies recognizing the region of EBA175 between from about the F2 domain to about the transmembrane domain of EBA175 were detected and acquired in an age-dependent manner. In particular, antibodies recognizing the region of EBA175 from amino acid 760 to 1271 of EBA175 (e.g. SEQ ID NO: 5) were detected and acquired in an age-dependent manner.

Comparison of inhibition of 3D7 and 3D7ΔEBA175 allows examination of human invasion-inhibitory antibodies specifically targeting EBA175. 15% of children and 17% of adults inhibited 3D7-wt more than 3D7ΔEBA175 (FIG. 3A), indicating individuals in the population have invasion-inhibitory antibodies against EBA175. These antibodies were responsible for up to 47% of the total inhibitory activity measured in some individuals (FIG. 5), indicating that EBA175 is an important target of invasion-inhibitory antibodies. In particular, invasion-inhibitory antibodies recognized the region of EBA175 from amino acid 760 to 1271 of EBA175.

To further examine the role of invasion-inhibitory antibodies to EBA175 in protection from malaria, the association of antibodies to EBA175 with time to first infection following drug treatment was examined in the same cohort of children in northern Papua New Guinea (FIGS. 10 A and B). In particular, antibodies recognizing the region of EBA175 between from about the F2 domain to about the transmembrane domain of EBA175 were associated with reduced risk of clinical malaria. In particular, antibodies recognizing the region of EBA175 from amino acid 760 to 1271 of EBA175 (e.g. SEQ ID NO: 5) were associated with reduced risk of clinical malaria.

Human antibodies to EBA181 were detected (FIG. 6D) in the serum samples used to identify invasion-inhibitory antibodies (FIGS. 1 to 5). In particular, antibodies recognizing the region of EBA181 between from about the F2 domain to about the transmembrane domain of EBA181 were detected and acquired in an age-dependent manner. In particular, antibodies recognizing the region of EBA181 from amino acid 755 to 1339 of EBA181 (e.g. SEQ ID NO: 7) were detected and acquired in an age-dependent manner.

To further examine the role of invasion-inhibitory antibodies to EBA181 in protection from malaria, the association of antibodies to EBA181 with time to first infection following drug treatment was examined in the same cohort of children in northern Papua New Guinea (FIGS. 10 A and C). In particular, antibodies recognizing the region of EBA181 between from about the F2 domain to about the transmembrane domain of EBA181 were associated with reduced risk of clinical malaria. In particular, antibodies recognizing the region of EBA181 from amino acid 755 to 1339 of EBA181 (e.g. SEQ ID NO: 7) were associated with reduced risk of clinical malaria.

Human antibodies to EBA140 were detected (FIG. 6C) in the serum samples used to identify invasion-inhibitory antibodies (FIGS. 1 to 5). In particular, antibodies recognizing the region of EBA140 between from about the F2 domain to about the transmembrane domain of EBA140 were detected and acquired in an age-dependent manner. In particular, antibodies recognizing the region of EBA140 from amino acid 746 to 1045 of EBA140 (e.g. SEQ ID NO: 9) were detected and acquired in an age-dependent manner.

To further examine the role of invasion-inhibitory antibodies to EBA140 in protection from malaria, the association of antibodies to EBA140 with time to first infection following drug treatment was examined in the same cohort of children in northern Papua New Guinea (FIGS. 10 A and D). In particular, antibodies recognizing the region of EBA140 between from about the F2 domain to about the transmembrane domain of EBA140 were associated with reduced risk of clinical malaria. In particular, antibodies recognizing the region of EBA140 from amino acid 746 to 1045 of EBA140 (e.g. SEQ ID NO: 9) were associated with reduced risk of clinical malaria.

Comparison of inhibition of 3D7 and 3D7ΔEBA140 allows examination of human invasion-inhibitory antibodies specifically targeting EBA140. Serum samples from children and adults inhibited 3D7-wt more than 3D7ΔEBA140 (FIG. 11), indicating individuals in the population have invasion-inhibitory antibodies against EBA140, indicating that EBA175 is an important target of invasion-inhibitory antibodies. In particular, invasion-inhibitory antibodies recognized the region of EBA140 from amino acid 746 to 1045 of EBA140.

Human antibodies to Rh2 were detected (FIG. 6F) in the serum samples used to identify invasion-inhibitory antibodies (FIGS. 1 to 5). In particular, antibodies recognizing the region of Rh2 between about 31 amino acids N-terminal of the Prodom PD006364 homology region to about the transmembrane domain of Rh2 were detected and acquired in an age-dependent manner. In particular, antibodies recognizing the region of Rh2 from amino acid 2027 to 2533 of Rh2 (e.g. SEQ ID NO: 1) were detected and acquired in an age-dependent manner. Also, antibodies recognizing the region of Rh2 from amino acid 2098 to 2597 of Rh2 were detected and acquired in an age-dependent manner (FIG. 8A). Also, antibodies recognizing the region of Rh2 from amino acid 2616 to 3115 of Rh2 were detected and acquired in an age-dependent manner (FIG. 5B).

To further examine the role of invasion-inhibitory antibodies to Rh2 in protection from malaria, the association of antibodies to Rh2 with time to first infection following drug treatment was examined in children in northern Papua New Guinea (FIG. 9). In particular, human antibodies recognizing Rh and EBA proteins were associated with reduced risk of clinical malaria. In particular, antibodies recognizing the region of Rh2 between about 31 amino acids N-terminal of the Prodom PD006364 homology region to about the transmembrane domain of Rh2 were associated with reduced risk of clinical malaria. In particular, antibodies recognizing the region of Rh2 from amino acid 2027 to 3115 of Rh2 (e.g. SEQ ID NO: 1) were associated with reduced risk of clinical malaria (FIG. 9). In particular, antibodies recognizing the region of Rh2 from amino acid 2098 to 2597 of Rh2 were associated with reduced risk of clinical malaria (FIG. 9A).

Also, antibodies recognizing the region of Rh2 from amino acid 2616 to 3115 of Rh2 were associated with reduced risk of clinical malaria (FIG. 9B).

Human antibodies to Rh4 were detected (FIG. 6E) in the serum samples used to identify invasion-inhibitory antibodies (FIGS. 1 to 5). In particular, antibodies recognizing the region of Rh4 between from about the MTH1187/YkoF-like superfamily domain to about the transmembrane domain of Rh4 were detected and acquired in an age-dependent manner. In particular, antibodies recognizing the region of Rh4 from amino acid 1160 to 1370 of Rh4 (e.g. SEQ ID NO: 3) were detected and acquired in an age-dependent manner.

To further examine the role of invasion-inhibitory antibodies to Rh4 in protection from malaria, the association of antibodies to Rh4 with time to first infection following drug treatment was examined in the same cohort of children in northern Papua New Guinea. In particular, antibodies recognizing the region of Rh4 from about the MTH1187/YkoF-like superfamily domain to about the transmembrane domain of Rh4 were associated with reduced risk of clinical malaria. In particular, antibodies recognizing the region of Rh4 from amino acid 1160 to 1370 of Rh4 (e.g. SEQ ID NO: 3) were associated with reduced risk of clinical malaria.

In one form of the immunogenic molecule, the contiguous amino acid sequence comprises about 5 or more amino acids. In another form, the contiguous amino acid sequence molecule comprises about 8, 10, 20, 50, or 100 amino acids. The skilled person is capable of routine experimentation designed to identify the shortest efficacious sequence, or the length of sequence that provides the greatest or most effective invasion-inhibitory response in the subject.

Similarly, the skilled person understands that strict compliance with any amino acid sequence disclosed herein is not necessarily required, and he or she could decide by a matter of routine whether any further mutation is deleterious or preferred. Thus, the immunogenic molecules of the present invention include sequences having 50% or more identity (e.g. 60%, 65%, 70%, 75%, 80%, 85%, 90%, 91%, 92%, 93%, 94%, 95%, 96%, 97%, 98%, 99%, 99.5% or more) to any protein disclosed herein. The immunogenic molecules also include variants (e.g. allelic variants, homologs, orthologs, paralogs, mutants, etc.). The molecules may lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus.

Expression of the immunogenic molecules of the invention may take place in *Plasmodium*, however other heterologous hosts may be utilised. The heterologous host may be prokaryotic (e.g. a bacterium) or eukaryotic. It is preferably *E. coli*, but other suitable hosts include *Bacillus subtilis, Vibrio cholerae, Salmonella typhi, Salmonella typhimurium, Neisseria lactamica, Neisseria cinerea, Mycobacteria* (e.g. *M. tuberculosis*), yeasts, etc. The immunogenic molecules of the present invention may be present in the composition as individual separate polypeptides. Generally, the recombinant fusion proteins of the present invention are prepared as a GST-fusion protein and/or a His-tagged fusion protein.

Polypeptides of the invention can be prepared by various means (e.g. recombinant expression, purification from cell culture, chemical synthesis, etc.) and in various forms (e.g. native, fusions, non-glycosylated, lipidated, etc.). They are preferably prepared in substantially pure form (i.e. substantially free from other Plasmodial or host cell proteins).

While the immunogenic molecule may comprise a single antigenic region, by the use of well-known recombinant DNA methods, more than one antigenic region may be included in a single immunogenic molecule. At least two (i.e. 2, 3, 4, 5, 6, 7, 8, 9, 10, 11, 12, 13, 14, 15, 16, 17, 18, 19, 20 or more) antigens can be expressed as a single polypeptide chain (a 'hybrid' polypeptide). Hybrid polypeptides offer two principal advantages: first, a polypeptide that may be unstable or poorly expressed on its own can be assisted by adding a suitable hybrid partner that overcomes the problem; second, commercial manufacture is simplified as only one expression and purification need be employed in order to produce two polypeptides which are both antigenically useful.

Hybrid polypeptides can be represented by the formula $NH_2$-A-(-X-L-)$_n$-B-COOH, wherein: X is an amino acid sequence of a *Plasmodium falciparum* antigen as defined herein; L is an optional linker amino acid sequence; A is an optional N-terminal amino acid sequence; B is an optional C-terminal amino acid sequence; and n is 2, 3, 4, 5, 6, 7, 8, 9, 10, 11, 12, 13, 14 or 15.

If a -X- moiety has a leader peptide sequence in its wild-type form, this may be included or omitted in the hybrid protein. In some embodiments, leader peptides (if present) will be deleted except for that of the -X- moiety located at the N-terminus of the hybrid protein i.e. a leader peptide of Xi will be retained, but the leader peptides of $X_2 \ldots X_n$ will be omitted. This is equivalent to deleting all leader peptides and using the leader peptide of $X_1$ as moiety -A-.

For each n instances of (-X-L-), linker amino acid sequence -L- may be present or absent. For instance, when n=2 the hybrid may be $NH_2$-$X_1$-$L_1$-$X_2$-$L_2$-COOH, $NH_2$-$X_1$-$X_2$-COOH$_5$ $NH_2$-$X_1$-$L_1$-$X_2$-COOH, $NH_2$-X1-X2-L2-COOH, etc. Linker amino acid sequencers) -L- will typically be short (e.g. 20 or fewer amino acids i.e. 19, 18, 17, 16, 15, 14, 13, 12, 11, 10, 9, 8, 7, 6, 5, 4, 3, 2, 1). Examples comprise short peptide sequences which facilitate cloning, poly-glycine linkers (i.e. comprising Gly$_n$ where n=2, 3, 4, 5, 6, 7, 8, 9, 10 or more), and histidine tags (i.e. His$_n$ where n=3, 4, 5, 6, 7, 8, 9, 10 or more). Other suitable linker amino acid sequences will be apparent to those skilled in the art. A useful linker is GSGGGG, with the Gly-Ser dipeptide being formed from a BamHI restriction site, thus aiding cloning and manipulation, and the (Gly)$_4$ tetrapeptide being a typical poly-glycine linker. The same variants apply to (-Y-L-). Therefore, for each m instances of (-Y-L-), linker amino acid sequence -L- may be present or absent.

-A- is an optional N-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. His$_n$ where n=3, 4, 5, 6, 7, 8, 9, 10 or more). Other suitable N-terminal amino acid sequences will be apparent to those skilled in the art. If $X_1$ lacks its own N-terminus methionine, -A- is preferably an oligopeptide (e.g. with 1, 2, 3, 4, 5, 6, 7 or 8 amino acids) which provides an N-terminus methionine.

-B- is an optional C-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include sequences to direct protein trafficking, short peptide sequences which facilitate cloning or purification (e.g. comprising histidine tags i.e. His$_n$, where n=3, 4, 5, 6, 7, 8, 9, 10 or more), or sequences which enhance protein stability. Other suitable C-terminal amino acid sequences will be apparent to those skilled in the art. Most preferably, n is 2 or 3.

The invention provides a process for producing an immunogenic molecule of the invention, comprising the step of synthesising at least part of the immunogenic molecule by chemical means.

Polypeptides used with the invention can be prepared by various means (e.g. recombinant expression, purification from cell culture, chemical synthesis, etc.). Recombinantly-expressed proteins are preferred, particularly for hybrid polypeptides.

Polypeptides used with the invention are preferably provided in purified or substantially purified form i.e. substantially free from other polypeptides (e.g. free from naturally-occurring polypeptides), particularly from other *Plasmodium* or host cell polypeptides, and are generally at least about 50% pure (by weight), and usually at least about 90% pure i.e. less than about 50%, and more preferably less than about 10% (e.g. 5%) of a composition is made up of other expressed polypeptides. Thus the antigens in the compositions are separated from the whole organism with which the molecule is expressed.

The present invention provides compositions comprising an immunogenic molecule as described herein. Compositions of the invention can be combined with pharmaceutically acceptable excipient. Such excipients include any excipient that does not itself induce the production of antibodies harmful to the individual receiving the composition. Suitable carriers are typically large, slowly metabolised macromolecules such as proteins, polysaccharides, polylactic acids, polyglycolic acids, polymeric amino acids, amino acid copolymers, sucrose, trehalose, lactose, and lipid aggregates (such as oil droplets or liposomes). Such carriers are well known to those of ordinary skill in the art. The vaccines may also contain diluents, such as water, saline, glycerol, etc. Additionally, auxiliary substances, such as wetting or emulsifying agents, pH buffering substances, and the like, may be present. Sterile pyrogen-free, phosphate-buffered physiologic saline is a typical carrier.

The pH of the composition is preferably between 6 and 8, preferably about 7. The pH may be maintained by the use of a buffer. A phosphate buffer is typical. The composition may be sterile and/or pyrogen-free. The composition may be isotonic with respect to humans. Compositions may include sodium salts (e.g. sodium chloride) to give tonicity. A concentration of 10+/−2 mg/ml NaCl is typical. Compositions may also comprise a detergent e.g. a Tween (polysorbate), such as Tween 80. Detergents are generally present at low levels e.g. <0.01%.

Compositions may comprise a sugar alcohol (e.g. mannitol) or a disaccharide (e.g. sucrose or trehalose) e.g. at around 15-30 mg/ml (e.g. 25 mg/ml), particularly if they are to be lyophilised or if they include material which has been reconstituted from lyophilised material. The pH of a composition for lyophilisation may be adjusted to around 6.1 prior to lyophilisation.

The composition may further comprise an antimalarial that is useful for the treatment of Plasmodial infection. Preferred antimalarials for use in the compositions include the chloroquine phosphate, proguanil, primaquine, doxycycline, mefloquine, clindamycin, halofantrine, quinine sulphate, quinine dihydrochloride, gluconate, primaquine phosphate and sulfadoxine.

The compositions of the invention may also comprise one or more immunoregulatory agents. Preferably, one or more of the immunoregulatory agents include(s) an adjuvant. The adjuvant may be selected from one or more of the group consisting of a TH1 adjuvant and TH2 adjuvant, further discussed below.

Adjuvants which may be used in compositions of the invention include, but are not limited to those described in the following passages.

Mineral containing compositions suitable for use as adjuvants in the invention include mineral salts, such as aluminium salts and calcium salts. The invention includes mineral salts such as hydroxides (e.g. oxyhydroxides), phosphates (e.g. hydroxyphosphates, orthophosphates), sulphates, etc. (e.g. see chapters 8 & 9 of Powell & Newman (eds.) Vaccine Design (1995) Plenum), or mixtures of different mineral compounds, with the compounds taking any suitable form (e.g. gel, crystalline, amorphous, etc.), and with adsorption being preferred. The mineral containing compositions may also be formulated as a particle of metal salt (WO00/23105).

A typical aluminium phosphate adjuvant is amorphous aluminium hydroxyphosphate with $PO_4/Al$ molar ratio between 0.84 and 0.92, included at 0.6 mg $Al^{3+}$/ml. Adsorption with a low dose of aluminium phosphate may be used e.g. between 50 and 100 μg $Al^{3+}$ per conjugate per dose. Where an aluminium phosphate it used and it is desired not to adsorb an antigen to the adjuvant, this is favoured by including free phosphate ions in solution (e.g. by the use of a phosphate buffer).

Oil emulsion compositions suitable for use as adjuvants in the invention include oil-in-water emulsions and water-in-oil emulsions.

A submicron oil-in-water emulsion may include squalene, Tween 80, and Span 85 e.g. with a composition by volume of about 5% squalene, about 0.5% polysorbate 80 and about 0.5% Span 85 (in weight terms, 4.3% squalene, 0.5% polysorbate 80 and 0.48% Span 85), known as 'MF595' (57-59 chapter 10 of Powell & Newman (eds.) Vaccine Design (1995) Plenum; chapter 12 of O'Hagen (ed.) Vaccine Adjuvants: Preparation Methods and Research Protocols (Volume 42 of Methods in Molecular Medicine series)). The MF59 emulsion advantageously includes citrate ions e.g. 10 mM sodium citrate buffer.

An emulsion of squalene, a tocopherol, and Tween 80 can be used. The emulsion may include phosphate buffered saline. It may also include Span 85 (e.g. at 1%) and/or lecithin. These emulsions may have from 2 to 10% squalene, from 2 to 10% tocopherol and from 0.3 to 3% Tween 80, and the weight ratio of squalene tocopherol is preferably <1 as this provides a more stable emulsion. One such emulsion can be made by dissolving Tween 80 in PBS to give a 2% solution, then mixing 90 ml of this solution with a mixture of (5 g of DL-α-tocopherol and 5 ml squalene), then microfluidising the mixture. The resulting emulsion may have submicron oil droplets e.g. with an average diameter of between 100 and 250 nm, preferably about 180 nm.

An emulsion of squalene, a tocopherol, and a Triton detergent (e.g. Triton X-100) can be used.

An emulsion of squalane, polysorbate 80 and poloxamer 401 ("Pluronic™ L 121") can be used. The emulsion can be formulated in phosphate buffered saline, pH 7.4. This emulsion is a useful delivery vehicle for muramyl dipeptides, and has been used with threonyl-MDP in the "SAF-I" adjuvant, (0.05-1% Thr-MDP, 5% squalane, 2.5% Pluronic L121 and 0.2% polysorbate 80). It can also be used without the Thr-MDP, as in the "AF" adjuvant (Hariharan et al. (1995) Cancer Res 55:3486-9) (5% squalane, 1.25% Pluronic L121 and 0.2% polysorbate 80). Microfluidisation is preferred.

Complete Freund's adjuvant (CFA) and incomplete Freund's adjuvant (IFA) may also be used.

Saponin formulations may also be used as adjuvants in the invention (see for example Chapter 22 of Powell & Newman (eds.) Vaccine Design (1995) Plenum). Saponins are a heterologous group of sterol glycosides and triterpenoid glycosides that are found in the bark, leaves, stems, roots and even flowers of a wide range of plant species. Saponin from the bark of the *Quillaia saponaria* Molina tree have been widely studied as adjuvants. Saponin can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs. QS21 is marketed as Stimulon™.

Saponin compositions have been purified using HPLC and RP-HPLC. Specific purified fractions using these techniques have been identified, including QS7, QS 17, QSI 8, QS21, QH-A, QH-B and QH-C. Preferably, the saponin is QS21. A method of production of QS21 is disclosed in ref. 63. Saponin formulations may also comprise a sterol, such as cholesterol (WO96/33739).

As discussed supra, combinations of saponins and cholesterols can be used to form unique particles called immunostimulating complexes (ISCOMs) (see for example Chapter 23 of Powell & Newman (eds.) Vaccine Design (1995) Plenum). ISCOMs typically also include a phospholipid such as phosphatidylethanolamine or phosphatidylcholine. Any known saponin can be used in ISCOMs. Preferably, the ISCOM includes one or more of QuilA, QHA and QHC. ISCOMs are further described in WO96/33739, EP-A-0109942, WO96/11711). Optionally, the ISCOMS may be devoid of additional detergent WO00/07621.

A review of the development of saponin based adjuvants can be found in Barr et al. (1998) Advanced Drug Delivery Reviews 32:247-271 and Sjolanderet et al. (1998) Advanced Drug Delivery Reviews 32:321-338.

Virosomes and virus-like particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein pi). VLPs are discussed further in (Niikura et al. (2002) Virology 293:273-280, Lenz et al. (2001) J Immunol 166:5346-5355, Pinto et al. (2003) J Infect Dis 188:327-338, Gerber et al. (2001) Virol 75:4752-4760, WO03/024480 and WO03/024481). Virosomes are discussed further in, for example, Gluck et al. (2002) Vaccine 20:B10-B16.

Adjuvants suitable for use in the invention include bacterial or microbial derivatives such as non-toxic derivatives of enterobacterial lipopolysaccharide (LPS), Lipid A derivatives, immunostiinulatory oligonucleotides and ADP-ribosylating toxins and detoxified derivatives thereof.

Non-toxic derivatives of LPS include monophosphoryl lipid A (MPL) and 3-O-deacylated MPL (3dMPL). 3dMPL is a mixture of 3 de-O-acylated monophosphoryl lipid A with 4, 5 or 6 acylated chains. A preferred "small particle" form of 3 De-O-acylated monophosphoryl lipid A is disclosed in ref. 77. Such "small particles" of 3dMPL are small enough to be sterile filtered through a 0.22 µm membrane (EP-A-0689454v). Other non-toxic LPS derivatives include monophosphoryl lipid A mimics, such as aminoalkyl glucosamine de phosphate derivatives e.g. RC-529 (Johnson et al (1999) Bioorg Med Chem Lett 9:2273-2278, Evans et al. (2003) Expert Rev Vaccines 2:219-229).

Lipid A derivatives include derivatives of lipid A from *Escherichia coli* such as OM-174. OM-174 is described for example in Meraldi et al. (2003) Vaccine 21:2485-2491, Pajak et al. (2003) Vaccine 21:836-842.

Immunostimulatory oligonucleotides suitable for use as adjuvants in the invention include nucleotide sequences containing a CpG motif (a dinucleotide sequence containing an unmethylated cytosine linked by a phosphate bond to a guanosine). Double-stranded RNAs and oligonucleotides containing palindromic or poly(dG) sequences have also been shown to be immunostimulatory.

The CpG's can include nucleotide modifications/analogs such as phosphorothioate modifications and can be double-stranded or single-stranded. Kandimalla et al (2003) Nucleic Acids Research 31: 2393-2400, WO02/26757 and WO99/62923 disclose possible analog substitutions e.g. replacement of guanosine with 2'-deoxy-7-deazaguanosine. The adjuvant effect of CpG oligonucleotides is further discussed in Krieg (2003) Nature Medicine 9:831-835, McCluskie et al. (2002) FEMS Immunology and Medical Microbiology 32:179-185, WO98/40100, U.S. Pat. No. 6,207,646, U.S. Pat. No. 6,239, 116 and U.S. Pat. No. 6,429,199.

The CpG sequence may be directed to TLR9, such as the motif GTCGTT or TTCGTT (Kandimalla et al. (2003) Biochemical Society Transactions 31 (part 3):654-658). The CpG sequence may be specific for inducing a TH1 immune response, such as a CpG-A ODN, or it may be more specific for inducing a B cell response, such a CpG-B ODN. CpG-A and CpG-B ODNs are discussed in refs. Blackwell et al. (2003) J Immunol 170:4061-4068, Krieg (2002) Trends Immunol 23:64-65. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, Kandimalla et al. (2003) Biochemical Society Transactions 31 (part 3):654-658, Kandimalla et al (2003), BBRC 306:948-953, Bhagat et al. (2003) BBRC 300:853-861 and WO03/035836.

Other immunostimulatory oligonucleotides include a double-stranded RNA or an oligonucleotide containing a palindromic sequence, or an oligonucleotide containing a poly (dG) sequence.

Bacterial ADP-ribosylating toxins and detoxified derivatives thereof may be used as adjuvants in the invention. Preferably, the protein is derived from *E. coli* (*E. coli* heat labile enterotoxin "LT"), cholera ("CT"), or pertussis ("PT"). The use of detoxified ADP-ribosylating toxins as mucosal adjuvants is described in WO95/17211 and as parenteral adjuvants in WO98/42375. The toxin or toxoid is preferably in the form of a holotoxin, comprising both A and B subunits. Preferably, the A subunit contains a detoxifying mutation; preferably the B subunit is not mutated. Preferably, the adjuvant is a detoxified LT mutant such as LT-K63, LT-R72, and LT-G192. The use of ADP-ribosylating toxins and detoxified derivatives thereof, particularly LT-K63 and LT-R72, as adjuvants can be found in Beignon et al. (2002) Infect Immun 70:3012-3019, Pizza et al. (2001) Vaccine 19:2534-2541, Pizza et al. (2000) Int J Med Microbiol 290:455-461, Scharton-Kersten et al. (2000) Infect Immun 68:5306-5313, Ryan et al. (1999) Infect Immun 67:6270-6280, Partidos et al. (1999) Immunol Lett 67:209-216, Peppoloni et al. (2003) Expert Rev Vaccines 2:285-293, Pine et al. (2002) J Control Release 85:263-270. Numerical reference for amino acid substitutions is preferably based on the alignments of the A and B subunits of ADP-ribosylating toxins set forth in Domenighini et al. (1995) Mol Microbiol 15:1165-1167, specifically incorporated herein by reference in its entirety.

Human immunomodulators suitable for use as adjuvants in the invention include cytokines, such as interleukins (e.g. IL-15 IL-2, IL-4, IL-5, IL-6, IL-7, IL-12, IL-17, IL-18 (WO99/40936), IL-23, IL27 (Matsui M. et al. (2004) J. Virol 78: 9093) etc.) (WO99/44636), interferons (e.g. interferon-γ), macrophage colony stimulating factor, tumor necrosis factor and macrophage inflammatory protein-1 alpha (MIP-1 alpha) and MIP-1 beta (Lillard J W et al, (2003) Blood 101(3):807-14).

Bioadhesives and mucoadhesives may also be used as adjuvants in the invention. Suitable bioadhesives include esterified hyaluronic acid microspheres (Singh et al) (2001) J Cont Release 70:267-276) or mucoadhesives such as cross-linked derivatives of poly(acrylic acid), polyvinyl alcohol, polyvinyl pyrollidone, polysaccharides and carboxymethylcellulose. Chitosan and derivatives thereof may also be used as adjuvants in the invention (WO99/27960).

Microparticles may also be used as adjuvants in the invention. Microparticles (i.e. a particle of ~100 nm to ~150 μm in diameter, more preferably ~200 nm to ~30 μm in diameter, and most preferably ~500 nm to ~10 μm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) are preferred, optionally treated to have a negatively-charged surface (e.g. with SDS) or a positively-charged surface (e.g. with a cationic detergent, such as CTAB). Examples of liposome formulations suitable for use as adjuvants are described in U.S. Pat. No. 6,090,406, U.S. Pat. No. 5,916,588, EP-A-0626169.

Adjuvants suitable for use in the invention include polyoxyethylene ethers and polyoxyethylene esters (WO99/52549). Such formulations further include polyoxyethylene sorbitan ester surfactants in combination with an octoxynol (WO01/21207) as well as polyoxyethylene alkyl ethers or ester surfactants in combination with at least one additional non-ionic surfactant such as an octoxynol (WO01/21152). Preferred polyoxyethylene ethers are selected from the following group: polyoxyethylene-9-lauryl ether (laureth 9), polyoxyethylene-9-steoryl ether, polyoxytheylene-8-steoryl ether, polyoxyethylene-4-lauryl ether, polyoxyethylene-35-lauryl ether, and polyoxyethylene-23-lauryl ether.

Phosphazene adjuvants include poly(di(carboxylatophenoxy)phosphazene) ("PCPP") as described, for example, in references Andrianov et al. (1998) Biomaterials 19:109-115 and Payne et al. (1998) Adv Drug Delivery Review 31:185-196.

Examples of muramyl peptides suitable for use as adjuvants in the invention include N-acetyl-muramyl-L-threonyl-D-isoglutamine (thr-MDP), N-acetyl-normuramyl-L-alanyl-D-isoglutamine (nor-MDP), and N-acetylmuramyl-L-alanyl-D-isoglutaminyl-L-alanine-2-(1'-2'-dipalmitoyl-sn-glycero-3-hydroxyphosphoryloxy)-ethylamine MTP-PE).

Imidazoquinoline adjuvants include Imiquimod ("R-837") (U.S. Pat. No. 4,680,338 and U.S. Pat. No. 4,988,815), Resiquimod ("R-848") (WO92/15582), and their analogs; and salts thereof (e.g. the hydrochloride salts). Further details about immunostimulatory imidazoquinolines can be found in references Stanley (2002) Clin Exp Dermatol 27:571-577, Wu et al. (2004) Antiviral Res. 64(2):79-83, Vasilakos et al. (2000) Cell Immunol. 204(I):64-74, U.S. Pat. Nos. 4,689,338, 4,929,624, 5,238,944, 5,266,575, 5,268,376, 5,346,905, 5,352,784, 5,389,640, 5,395,937, 5,482,936, 5,494,916, 5,525,612, 6,083,505, 6,440,992, 6,627,640, 6,656,938, 6,660,735, 6,660,747, 6,664,260, 6,664,264, 6,664,265, 6,667,312, 6,670,372, 6,677,347, 6,677,348, 6,677,349, 6,683,088, 6,703,402, 6,743,920, 6,800,624, 6,809,203, 6,888,000 and 6924293 and Jones (2003) Curr Opin Investig Drugs 4:214-218.

Thiosemicarbazone adjuvants include those disclosed in WO2004/060308. Methods of formulating, manufacturing, and screening for active compounds are also described in WO2004/060308. The thiosemicarbazones are particularly effective in the stimulation of human peripheral blood mononuclear cells for the production of cytokines, such as TNF-α.

Tryptanthrin adjuvants include those disclosed in WO2004/064759. Methods of formulating, manufacturing, and screening for active compounds are also described in WO20041064759. The thiosemicarbazones are particularly effective in the stimulation of human peripheral blood mononuclear cells for the production of cytokines, such as TNF-α.

Various nucleoside analogs can be used as adjuvants, such as (a) isatorabine (ANA-245: 7-thia-8-oxoguanosine) and prodrugs thereof; (b) ANA975; (c) ANA-025-1; (d) ANA380; (e) the compounds disclosed in U.S. Pat. No. 6,924,271, US2005/0070556 and U.S. Pat. No. 5,658,731, or (f) a pharmaceutically acceptable salt of any of (a) to (g), a tautomer of any of (a) to (g), or a pharmaceutically acceptable salt of the tautomer.

Q. Lipids linked to a phosphate-containing acyclic backbone Adjuvants containing lipids linked to a phosphate-containing acyclic backbone include the TLR4 antagonist E5564 (Wong et al. (2003) J Clin Pharmacol 43(7):735-42 and US200510215517).

Small molecule immunopotentiators useful as adjuvants include N2-methyl-1-(2-methylpropyl)-1H-imidazo[4,5-c]quinoline-2,4-diamine; N2,N2-dimethyl-1-(2-methylpropyl)-1H-imidazo[4,5-c]quinoline-2,4-diamine; N2-ethyl-N2-methyl-1-(2-methylpropyl)-1H-imidazo[4,5-c]quinoline-2,4-diamine; N2-methyl-1-(2-methylpropyl)-N2-propyl-1H-imidazo[4,5-c]quinoline-2,4-diamine; 1-(2-methylpropyl)-N2-propyl-1H-imidazo[4,5-c]quinoline-2,4-diamine; N2-butyl-1-(2-methylpropyl)-1H-imidazo[4,5-c]quinoline-2,4-diamine; N2-butyl-N2-methyl-1-(2-methylpropyl)-1H-imidazo[4,5-c]quinoline-2,4-diamine; N2-methyl-1-(2-methylpropyl)-N2-pentyl-1H-imidazo[4,5-c]quinoline-2,4-diamine; N2-methyl-1-(2-methylpropyl)-N2-prop-2-enyl-1H-imidazo[4,5-c]quinoline-2,4-diamine; 1-(2-methylpropyl)-2-((phenylmethyl)thio)-1H-imidazo(4,5-c)quinolin-4-amine; 1-(2-methylpropyl)-2-(propylthio)-1H-imidazo[4,5-c]quinolin-4-amine; 2-((4-amino-1-(2-methylpropyl)-1H-imidazo[4,5-c]quinolin-2-yl)(methyl) amino)ethanol; 2-((4-amino-1-(2-methylpropyl)-1H-imidazo(455-c)quinolin-2-yl)(methyl)amino)ethyl acetate; 4-amino-1-(2-methylpropyl)-1,3-dihydro-2H-imidazo[4,5-c]quinolin-2-one; N2-butyl-1-(2-methylpropyl)-N4,N4-bis(phenylmethyl)-1H-imidazo[4,5-c]quinoline-2,4-diamine; N2-butyl-N2-methyl-1-(2-methylpropyl)-N4,N4-bis(phenylmethyl)-1H-imidazo[4,5-c]quinoline-2,4-diamine; N2-methyl-1-(2-methylpropyl)-N4,N4-bis(phenylmethyl)-1H-imidazo[4,5-c]quinoline-2,4-diamine; N2,N2-dimethyl-1-(2-methylpropyl)-N4,N4-bis(phenylmethyl)-1H-imidazo[4,5-c]quinoline-2,4-diamine; 1-(4-amino-2-(methyl (propyl)amino)-1H-imidazo[4,5-c]quinolin-1-yl}-2-methylpropan-2-ol; 1-(4-amino-2-(propylamino)-1H-imidazo[4,5-c]quinolin-1-yl)-2-methylpropan-2-ol; N43N4-dibenzyl-1-(2-methoxy-2-methylpropyl)-N2propyl-1H-imidazo[4,5-c]quinoline-2,4-diamine.

One potentially useful adjuvant is an outer membrane protein proteosome preparation prepared from a first Gram-negative bacterium in combination with a liposaccharide preparation derived from a second Gram-negative bacterium, wherein the outer membrane protein proteosome and liposaccharide preparations form a stable non-covalent adjuvant complex. Such complexes include "IVX-908", a complex comprised of *Neisseria meningitidis* outer membrane and lipopolysaccharides. They have been used as adjuvants for influenza vaccines (WO02/072012).

Other substances that act as immunostimulating agents are disclosed in Vaccine Design ((1995) eds. Powell & Newman. ISBN: 030644867X. Plenum) and Vaccine Adjuvants: Preparation Methods and Research Protocols (Volume 42 of Methods in Molecular Medicine series) (ISBN: 1-59259-083-7. Ed. O'Hagan). Further useful adjuvant substances include: Methyl inosine 5'-monophosphate ("MIMP") Signorelli & Hadden (2003) Int Immunopharmacol 3(8):1177); a polyhydroxlated pyrrolizidine compound (WO2004/064715), examples include, but are not limited to: casuarine, casuarine-6-α-D-glucopyranose, 3-epz-casuarine, 7-epz-casuarine, 3,7-diepz-casuarine, etc; a gamma inulin (Cooper (1995) Phar Biotechnol 6:559) or derivative thereof, such as algammulin; compounds disclosed in PCT/US2005/022769; compounds disclosed in WO2004/87153, including: Acylpiperazine compounds, Indoledione compounds, Tetrahydraisoquinoline (THIQ) compounds, Benzocyclodione compounds, Aminoazavinyl compounds, Aminobenzimidazole quinolinone (ABIQ) compounds (U.S. Pat. No. 6,606,617, WO02/018383), Hydrapthalamide compounds, Benzophenone compounds, Isoxazole compounds, Sterol compounds, Quinazilinone compounds, Pyrrole compounds (WO/04/018455), Anthraquinone compounds, Quinoxaline compounds, Triazine compounds, Pyrazalopyrimidine compounds, and Benzazole compounds (WO03/082272); loxoribine (7-allyl-8-oxoguanosine) (U.S. Pat. No. 5,011,828); a formulation of a cationic lipid and a (usually neutral) co-lipid, such as aminopropyl-dimethyl-myristoleyloxy-propanaminium bromide-diphytanoylphosphatidyl-ethanolamine ("Vaxfectin™") or aminopropyl-dim ethyl-bis-dodecyloxy-propanaminium bromide-dioleoylphosphatidyl-ethanolamine ("GAP-DLRIE:DOPE"). Formulations containing (±)-N-(3-aminopropyl)-N,N-dimethyl-2,3-bis(syn-9-tetradeceneyloxy)-1-propanaminium salts are preferred (U.S. Pat. No. 6,586,409).

The invention may also comprise combinations of aspects of one or more of the adjuvants identified above. For example, the following adjuvant compositions may be used in the invention: (1) a saponin and an oil-in-water emulsion (WO99/11241); (2) a saponin (e.g. QS21)+a nontoxic LPS derivative (e.g. 3dMPL) (WO94/00153); (3) a saponin (e.g. QS21)+a non-toxic LPS derivative (e.g. 3dMPL)+a cholesterol; (4) a saponin (e.g. QS21)+3dMPL+IL-12 (optionally+a sterol) (WO98/57659); (5) combinations of 3dMPL with, for example, QS21 and/or oil-in-water emulsions (EP0835318, EP0735898, EP0761231); (6) Ribi™ adjuvant system (RAS), (Ribi Immunochem) containing 2% squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); and (7) one or more mineral salts (such as an aluminum salt)+a non-toxic derivative of LPS (such as 3dMPL).

In one embodiment of the invention the composition comprises a *Plasmodium falciparum* invasion protein of the EBA family. As discussed supra, EBA proteins have also been found by the Applicants to be capable of eliciting an invasion-inhibitory immune response. The use of compositions containing combinations of Rh and EBA proteins relates to the Applicants further discovery that the *Plasmodium falciparum* parasite is capable of evading the host immune response by switching from the use of one invasion protein to another. For example, if the parasite initially utilised a Rh-mediated invasion pathway the host will generate antibodies capable of blocking the method of entry. The parasite is capable of then using an alternative pathway (such as an EBA-mediated pathway) in order to evade the host immune response.

Data provided herein establishes that the invasion-inhibitory activity of naturally acquired antimalarial antibodies is influenced by phenotypic variation in erythrocyte invasion pathways and suggests that the use of alternative invasion pathways may act as a mechanism of immune evasion. These findings indicate members of the EBA and Rh invasion ligand families are key targets of inhibitory antibodies. This knowledge is highly significant for understanding the acquisition of malarial immunity and the capacity of *Plasmodium falciparum* to cause repeated infections, and will aid the prioritisation and validation of candidate vaccine antigens. This establishes, in *Plasmodium falciparum*, the presence of a novel mechanism of immune evasion among microbial pathogens, which may be relevant to other organisms.

Comparing antibody inhibition of W2mef lines with different invasion phenotypes enabled a clear evaluation of the effect of variation in invasion pathway use on the efficacy of inhibitory antibodies (EXAMPLES 1 to 6). W2mefΔEBA175 uses an alternate SA-independent invasion pathway compared to the parental W2mef-wt (SA-dependent). Many samples that inhibited the parental W2mef lost their inhibitory activity against W2mefΔEBA175, providing evidence that a switch in invasion pathway use can facilitate immune evasion. These results were confirmed using W2mefSelNm, a line that is genetically intact and uses a SA-independent pathway following selection for invasion into neuraminidase-treated erythrocytes. The present invention also demonstrates that invasion pathway use alters susceptibility to inhibitory antibodies using a genetically different isolate, 3D7. By varying the use of different members of the EBA and Rh ligand families, *Plasmodium falciparum* appears to evade invasion-inhibitory antibodies targeting specific EBA and Rh proteins. In addition to explaining the lack of phenotype observed for *Plasmodium falciparum* lines disrupted for these molecules on untreated red cells, this surprising result explains the lack of invasion inhibition observed using antibodies to the Rh family of molecules on untreated cells (e.g. Rh2, as discussed supra). The present invention demonstrates that effective immunity may depend on the presence of antibodies against a broad range of invasion ligands, in particular antibodies against both SA-dependent invasion and SA-independent invasion ligands, and defines the ligands responsible for this immune invasion (e.g. Rh1, Rh2, Rh4, EBA175, EBA181, and EBA140).

Greater inhibition of W2mef-wt compared to W2mefΔEBA175 or W2mefSelNm by samples from exposed donors points to antibodies targeting the EBAs and Rh1, which define the SA-dependent pathway. EBA175 is the major target of these antibodies as it is essential for utilisation of the SA-dependent invasion pathway in enzyme treated red cells. Disruption of EBA175 in W2mef results in a switch to an alternative SA-independent invasion pathway in enzyme treated red cells that is Rh4-dependent. This indicates that EBA175 is the major determinant of erythrocyte SA-dependent invasion in W2mef-wt parasites. On the other hand, greater inhibition of W2mefΔEBA175 or W2mefSelNm compared to W2mef-wt indicates the presence of human invasion-inhibitory antibodies against Rh4 and Rh2, as discussed supra and demonstrated in FIGS. 1, 2, and 3. Furthermore, FIG. 12 demonstrates antibodies to Rh2 inhibit *Plasmodium falciparum* lines in which SA-dependent invasion has been reduced by disruption of EBA175 or EBA140 into normal untreated red cells. This demonstrates that there is synergy between the inhibition of invasion by targeting both major pathways of invasion (SA-dependent and SA-independent) into untreated red cells. By targeting the ligands that mediate invasion via these pathways (e.g. Rh1, Rh2, Rh4, EBA175, EBA140 and EBA181), invasion-inhibition on untreated cells is achieved. In particular, rabbit antibodies recognizing the region of Rh2 between about 31 amino acids N-terminal of the Prodom PD006364 homology region to about the transmembrane domain of Rh2 inhibited invasion of *Plasmodium falciparum* parasites on untreated red cells in which EBA175 or EBA140 or EBA175 and EBA140 has been disrupted relative to wild-type *Plasmodium falciparum* (FIG. 12). In particular, antibodies recognizing the region of Rh2 from amino acid 2027 to 3115 of Rh2 (e.g. SEQ ID NO: 1) inhibited invasion on untreated red cells. In particular, antibodies recognizing the region of Rh2 from amino acid 2616 to 3115 of Rh2 inhibited invasion on untreated red cells.

Given the demonstration of the advantages gained by targeting two discrete invasion pathways, one embodiment of the composition comprises a contiguous amino acid sequence of a reticulocyte-binding protein homologue (Rh) protein of the strain of *Plasmodium falciparum*, wherein when administered to a subject the Rh protein is capable of inducing an invasion-inhibitory immune response to the strain. The Rh may be Rh1, Rh2a, Rh2b or Rh4. In one form of the immunogenic molecule, the Rh molecule is Rh2b, and the contiguous amino acid sequence is found in SEQ ID NO: 1:

```
Amino acid sequence of Rh2b (PlasmoDB Accession
No: MAL13P1.176)
                                              SEQ ID NO: 1
MKRSLINLENDLFRLEPISYIQRYYKKNINRSDIFHNKKERGSKVYSNVSSFHSFIQEGK

EEVEVFSIWGSNSVLDHIDVLRDNGTVVFSVQPYYLDIYTCKEAILFTTSFYKDLDKSSI

TKINEDIEKFNEEIIKNEEQCLVGGKTDFDNLLIVLENAEKANVRKTLFDNTFNDYKNKK

SSFYNCLKNKKNDYDKKIKNITKLLKNIESTGNMCKTESYVMNNNLYLLRVNEVKS

TPIDLYLNRAKELLESSSKLVNPIKMKLGDNKNMYSIGYIHDEIKDIIKRYNFHLKHIEK

GKEYIKRITQANNIADKMKKDELIKKIFESSKHFASFKYSNEMISKLDSLFIKNEEILNN

LFNNIFNIFKKKYETYVDMKTIESKYTTVMTLSEHLLEYAMDVLKANPQKPIDPKANLDS

EVVKLQIKINEKSNELDNAISQVKTLIIIMKSFYDIIISEKASMDEMEKKELSLNNYIEK

TDYILQTYNIFKSKSNIINNNSKNISSKYITIEGLKNDIDELNSLISYFKDSQETLIKDD

ELKKNMKTDYLNNVKYIEENVTHINEIILLKDSITQRIADIDELNSLNLININDFINEKN

ISQEKVSYNLNKLYKGSFEELESELSHFLDTKYLFHEKKSVNELQTILNTSNNECAKLNF

MKSDNNNNNNNSNIINLLKTELSHLLSLKENIIKKLLNHIEQNIQNSSNKYTITYTDINN

RMEDYKEEIESLEVYKHTIGNIQKEYILHLYENDKNALAVHNTSMQILQYKDAIQNIKNK

ISDDIKILKKYKEMNQDLLNYYEILDKKLKDNTYIKEMHTASLVQITQYIPYEDKTISEL

EQEFNNNNQKLDNILQDINAMNLNINILQTLNIGINACNTNNKNVEHLLNKKIELKNILN

DQMKIIKNDDIIQDNEKENFSNVLKKEEEKLEKELDDIKFNNLKMDIHKLLNSYDHTKQN

IESNLKINLDSFEKEKDSWVHFKSTIDSLYVEYNICNQKTHNTIKQQKNDIIELIYKRIK

DINQEIIEKVDNYYSLSDKALTKLKSIHFNIDKEKYKNPKSQENIKLLEDRVMILEKKIK

EDKDALIQIKNLSHDHFVNADNEKKKQKEKEEDDEQTHYSKKRKVMGDIYKDIKKNLDEL

NNKNLIDITLNEANKIESEYEKILIDDICEQITNEAKKSDTIKEKIESYKKDIDYVDVDV

SKTRNDHHLNGDKIHDSFFYEDTLNYKAYFDKLKDLYENINKLTNESNGLKSDAHNNNTQ

VDKLKEINLQVFSNLGNIIKYVEKLENTLHELKDMYEFLETIDINKILKSIHNSMKKSEE

YSNETKKIFEQSVNITNQFIEDVEILKTSINPNYESLNDDQIDDNIKSLVLKKEEISEKR

KQVNKYITDIESNKEQSDLHLRYASRSIYVIDLFIKHEIINPSDGKNFDIIKVKEMINKT

KQVSNEAMEYANKMDEKNKDIIKIENELYNLINNNIRSLKGVKYEKVRKQARNAIDDINN

IHSNIKTILTKSKERLDEIKKQPNIKREGDVLNNDKTKIAYITIQINNGRIESNLLNILN

MKHNIDTILNKAMDYMNDVSKSDQIVINIDSLNMNDIYNKDKDLLINILKEKQNMEAEYK

KMNEMYNYVNETEKEIIKHKKNYEIRIMEHIKKETNEKKKKFMESNNKSLTTLMDSFRSM

FYNEYINDYNINENFEKHQNILNEIYNGFNESYNIINTKMTEIINDNLDYNEIKEIKEVA
```

```
QTEYDKLNKKVDELKNYLNNIKEQEGHRLIDYIKEKIFNLYIKCSEQQNIIDDSYNYITV

KKQYIKTIEDVKFLLDSLNTIEEKNKSVANLEICTNKEDIKNLLKHVIKLANFSGIIVMS

DTNTEITPENPLEDNDLLNLQLYFERKHEITSTLENDSDLELDHLGSNSDESIDNLKVYN

DIIELHTYSTQILKYLDNIQKLKGDCNDLVKDCKELRELSTALYDLKIQITSVINRENDI

SNNIDIVSNKLNEIDAIQYNFEKYKEIFDNVEEYKTLDDTKNAYIVKKAEILKNVDINKT

KEDLDIYFNDLDELEKSLTLSSNEMEIKTIVQNSYNSFSDINKNINDIDKEMKTLIPMLD

ELLNEGHNIDISLYNFIIRNIQIKIGNDIKNIREQENDTNICFEYIQNNYNFIKSDISIF

NKYDDHIKVDNYISNNIDVVNKHNSLLSEHVINATNIIENIMTSIVEINEDTEMNSLEET

QDKLLELYENFKKEKNIINNNYKIVHFNKLKEIENSLETYNSISTNFNKINETQNIDILK

NEFNNIKTKINDKVKELVHVDSTLTLESIQTFNNLYGDLMSNIQDVYKYEDINNVELKKV

KLYIENITNLLGRINTFIKELDKYQDENNGIDKYIEINKENNSYIIKLKEKANNLKENFS

KLLQNIKRNETELYNINNIKDDIMNTGKSVNNIKQKFSSNLPLKEKLFQMEEMLLNINNI

MNETKRISNTDAYTNITLQDIENNKNKENNNMNIETIDKLIDHIKIHNEKIQAEILIIDD

AKRKVKEITDNINKAFNEITENYNNENNGVIKSAKNIVDKATYLNNELDKFLLKLNELLS

HNNNDIKDLGDEKLILKEEEERKERERLEKAKQEEERKERERIEKEKQEKERLEREKQEQ

LKKEALKKQEQERQEQQQKEEALKRQEQERLQKEEELKRQEQERLEREKQEQLQKEEELR

KKEQEKQQQRNIQELEEQKKPEIINEALVKGDKILEGSDQRNMELSKPNVSMDNTNNSPI

SNSEITESDDIDNSENIHTSHMSDIESTQTSHRSNTHGQQISDIVEDQITHPSNIGGEKI

THNDEISITGERNNISDVNDYSESSNIFENGDSTINTSTRNTSSTHDESHISPISNAYDH

VVSDNKKSMDENIKDKLKIDESITTDEQIRLDDNSNIVRIDSTDQRDASSHGSSNRDDDE

ISHVGSDIHMDSVDIHDSIDTDENADHRHNVNSVDSLSSSDYTDTQKDFSSIIKDGGNKE

GHAENESKEYESQTEQTHEEGIMNPNKYSISEVDGIKLNEEAKHKITEKLVDIYPSTYRT

LDEPMETHGPNEKFHMFGSPYVTEEDYTEKHDYDKHEDFNNERYSNHNKMDDFVYNAGGV

VCCVLFFASITFFSMDRSNKDECDFDMCEEVNNNDHLSNYADKEEIIEIVFDENEEKYF
```

Mutations of SEQ ID NO:1 are also included in the scope of this invention and include embodiments whereby D at amino acid 2471 is replaced with A, K at amino acid 2560 is replaced with E, K at amino acid 3090 is replaced with N, N at amino acid 3116 replaced with T, N at amino acid 3116 is replaced with Y.

Representative examples of Rh2b sequences are disclosed in GenBank as follows: *Plasmodium falciparum* normocyte-binding protein 2b gene (3D7): AY138500 (SEQ ID NO: 23), *Plasmodium falciparum* normocyte-binding protein 2b gene (7G8): AY138501 (SEQ ID NO: 24), *Plasmodium falciparum* normocyte-binding protein 2b gene (Dd2): AY138502 (SEQ ID NO: 25), *Plasmodium falciparum* normocyte-binding protein 2b gene (FVO): AY138503 (SEQ ID NO: 26).

More particularly, the contiguous amino acid sequence may found in the region between about 31 amino acids N-terminal of the Prodom PD006364 homology region to about the transmembrane domain of Rh2b. The contiguous amino acid sequence may also be found in the region from about residue 2027 to 3115 of Rh2b, or more particularly from about residue 2027 to about residue 2533 of Rh2b.

In one form of the immunogenic molecule the contiguous amino acid sequence is found in the region between about residue 1288 to about residue 1856. In one form of the immunogenic molecule the contiguous amino acid sequence is found in the region between about residue 297 to about residue 726. In one form of the immunogenic molecule the contiguous amino acid sequence is found in the region between about residue 34 to about residue 322. In one form of the immunogenic molecule the contiguous amino acid sequence is found in the region between about residue 673 to about residue 1288. In one form of the immunogenic molecule the contiguous amino acid sequence is found in the region between about residue 2030 to about residue 2528. In one form of the immunogenic molecule the contiguous amino acid sequence is found in the region between about residue 2792 to about residue 3185.

In another form of the immunogenic molecule the contiguous amino acid sequence is found in the region from about residue 2098 to about residue 2597, or the region from about 2616 to 3115 of Rh2b.

In one form of the immunogenic molecule, the Rh molecule is Rh2a, and the contiguous amino acid sequence is found in SEQ ID NO: 11:

SEQ ID NO: 11 Amino acid sequence of Rh2a (PlasmoDB
Accession No: PF13_0198)

MKTTLFCSISFCNIIFFFLELSHEHFVGQSSNTHGASSVTDFNFSEEKNLKSFEGKNNNN
DNYASINRLYRKKPYMKRSLINLENDLFRLEPISYIQRYYKKNINRSDIFHNKKERGSKV
YSNVSSFHSFIQEGKEEVEVFSIWGSNSVLDHIDVLRDNGTVVFSVQPYYLDIYTCKEAI
LFTTSFYKDLDKSSITKINEDIEKFNEEIIKNEEQCLVGGKTDFDNLLIVLENAEKANVR
KTLFDNTFNDYKNKKSSFYNCLKNKKNDYDKKIKNIKNEITKLLKNIESTGNMCKTESYV
MNNNLYLLRVNEVKSTPIDLYLNRAKELLESSSKLVNPIKMKLGDNKNMYSIGYIHDEIK
DIIKRYNFHLKHIEKGKEYIKRITQANNIADKMKKDELIKKIFESSKHFASFKYSNEMIS
KLDSLFIKNEEILNNLFNNIFNIFKKKYETYVDMKTIESKYTTVMTLSEHLLEYAMDVLK
ANPQKPIDPKANLDSEVVKLQIKINEKSNELDNAISQVKTLIIIMKSFYDIIISEKASMD
EMEKKELSLNNYIEKTDYILQTYNIFKSKSNIINNNSKNISSKYITIEGLKNDIDELNSL
ISYFKDSQETLIKDDELKKNMKTDYLNNVKYIEENVTHINEIILLKDSITQRIADIDELN
SLNLININDFINEKNISQEKVSYNLNKLYKGSFEELESELSHFLDTKYLFHEKKSVNELQ
TILNTSNNECAKLNFMKSDNNNNNNNSNIINLLKTELSHLLSLKENIIKKLLNHIEQNIQ
NSSNKYTITYTDINNRMEDYKEEIESLEVYKHTIGNIQKEYILHLYENDKNALAVHNTSM
QILQYKDAIQNIKNKISDDIKILKKYKEMNQDLLNYYEILDKKLKDNTYIKEMHTASLVQ
ITQYIPYEDKTISELEQEFNNNNQKLDNILQDINAMNLNINILQTLNIGINACNTNNKNV
EHLLNKKIELKNILNDQMKIIKNDDIIQDNEKENFSNVLKKEEEKLEKELDDIKFNNLKM
DIHKLLNSYDHTKQNIESNLKINLDSFEKEKDSWVHFKSTIDSLYVEYNICNQKTHNTIK
QQKNDIIELIYKRIKDINQEIIEKVDNYYSLSDKALTKLKSIHFNIDKEKYKNPKSQENI
KLLEDRVMILEKKIKEDKDALIQIKNLSHDHFVNADNEKKKQKEKEEDDEQTHYSKKRKV
MGDIYKDIKKNLDELNNKNLIDITLNEANKIESEYEKILIDDICEQITNEAKKSDTIKEK
IESYKKDIDYVDVDVSKTRNDHHLNGDKIHDSFFYEDTLNYKAYFDKLKDLYENINKLTN
ESNGLKSDAHNNNTQVDKLKEINLQVFSNLGNIIKYVEKLENTLHELKDMYEFLETIDIN
KILKSIHNSMKKSEEYSNETKKIFEQSVNITNQFIEDVEILKTSINPNYESLNDDQIDDN
IKSLVLKKEEISEKRKQVNKYITDIESNKEQSDLHLRYASRSIYVIDLFIKHEIINPSDG
KNFDIIKVKEMINKTKQVSNEAMEYANKMDEKNKDIIKIENELYNLINNNIRSLKGVKYE
KVRKQARNAIDDINNIHSNIKTILTKSKERLDEIKKQPNIKREGDVLNNDKTKIAYITIQ
INNGRIESNLLNILNMKHNIDTILNKAMDYMNDVSKSDQIVINIDSLNMNDIYNKDKDLL
INILKEKQNMEAEYKKMNEMYNYVNETEKEIIKHKKNYEIRIMEHIKKETNEKKKKFMES
NNKSLTTLMDSFRSMFYNEYINDYNINENFEKHQNILNEIYNGFNESYNIINTKMTEIIN
DNLDYNEIKEIKEVAQTEYDKLNKKVDELKNYLNNIKEQEGHRLIDYIKEKIFNLYIKCS
EQQNIIDDSYNYITVKKQYIKTIEDVKFLLDSLNTIEEKNKSVANLEICTNKEDIKNLLK
HVIKLANFSGIIVMSDTNTEITPENPLEDNDLLNLQLYFERKHEITSTLENDSDLELDHL
GSNSDESIDNLKVYNDIIELHTYSTQILKYLDNIQKLKGDCNDLVKDCKELRELSTALYD
LKIQITSVINRENDISNNIDIVSNKLNEIDAIQYNFEKYKEIFDNVEEYKTLDDTKNAYI
VKKAEILKNVDINKTKEDLDIYFNDLDELEKSLTLSSNEMEIKTIVQNSYNSFSDINKNI
NDIDKEMKTLIPMLDELLNEGHNIDISLYNFIIRNIQIKIGNDIKNIREQENDTNICFEY
IQNNYNFIKSDISIFNKYDDHIKVDNYISNNIDVVNKHNSLLSEHVINATNIIENIMTSI
VEINEDTEMNSLEETQDKLLELYENFKKEKNIINNNYKIVHFNKLKEIENSLETYNSIST
NFNKINETQNIDILKNEFNNIKTKINDKVKELVHVDSTLTLESIQTFNNLYGDLMSNIQD

```
-continued
VYKYEDINNVELKKVKLYIENITNLLGRINTFIKELDKYQDENNGIDKYIEINKENNSYI

IKLKEKANNLKENFSKLLQNIKRNETELYNINNIKDDIMNTGKSVNNIKQKFSSNLPLKE

KLFQMEEMLLNINNIMNETKRISNTAAYTNITLQDIENNKNKENNNMNIETIDKLIDHIK

IHNEKIQAEILIIDDAKRKVKEITDNINKAFNEITENYNNENNGVIKSAKNIVDEATYLN

NELDKFLLKLNELLSHNNNDIKDLGDEKLILKEEEERKERERLEKAKQEEERKERERIEK

EKQEKERLEREKQEQLKKEEELRKKEQERQEQQQKEEALKRQEQERLQKEEELKRQEQER

LEREKQEQLQKEEELKRQEQERLQKEEALKRQEQERLQKEEELKRQEQERLEREKQEQLQ

KEEELKRQEQERLQKEEALKRQEQERLQKEEELKRQEQERLERKKIELAEREQHIKSKLE

SDMVKIIKDELTKEKDEIIKNKDIKLRHSLEQKWLKHLQNILSLKIDSLLNKNDEVIKDN

ETQLKTNILNSLKNQLYLNLKRELNEIIKEYEENQKKILHSNQLVNDSLEQKTNRLVDIK

PTKHGDIYTNKLSDNETEMLITSKEKKDETESTKRSGTDHTNSSESTTDDNTNDRNFSRS

KNLSVAIYTAGSVALCVLIFSSIGLLLIKTNSGDNNSNEINEAFEPNDDVLFKEKDEIIE

ITFNDNDSTI
```

Mutations of SEQ ID NO:11 are also included in the scope of this invention and include embodiments whereby A at amino acid 2546 is replaced with D, E at amino acid 2613 is replaced with G, R at amino acid 2723 is replaced with K, K at amino acid 2725 replaced with Q.

Representative examples of Rh2a sequences are disclosed in GenBank as follows: *Plasmodium falciparum* normocyte-binding protein 2a gene (3D7): AY138496 (SEQ ID NO: 27), *Plasmodium falciparum* normocyte-binding protein 2a gene (7G8): AY138497 (SEQ ID NO: 28), *Plasmodium falciparum* normocyte-binding protein 2a gene (Dd2): AY138498 (SEQ ID NO: 29), *Plasmodium falciparum* normocyte-binding protein 2a gene (FVO): AY138499 (SEQ ID NO: 30)

More particularly, the contiguous amino acid sequence may found in the region between about 31 amino acids N-terminal of the Prodom PD006364 homology region to about the transmembrane domain of Rh2a. The contiguous amino acid sequence may also be found in the region from about residue 2133 to about residue 3065 of Rh2a.

In another form of the immunogenic molecule the contiguous amino acid sequence is found in the region from about residue 2098 to about residue 2597, or the region from about residue 2616 to about residue 3115 of Rh2a.

In one form of the immunogenic molecule the contiguous amino acid sequence is found in the region between about residue 1288 to about residue 1856. In one form of the immunogenic molecule the contiguous amino acid sequence is found in the region between about residue 297 to about residue 726. In one form of the immunogenic molecule the contiguous amino acid sequence is found in the region between about residue 34 to about residue 322. In one form of the immunogenic molecule the contiguous amino acid sequence is found in the region between about residue 673 to about residue 1288. In one form of the immunogenic molecule the contiguous amino acid sequence is found in the region between about residue 2030 to about residue 2528. In another form of the immunogenic molecule the contiguous amino acid sequence is found in the region between about residue 2530 to about residue 3029. In another form of the immunogenic molecule the contiguous amino acid sequence is found in the region between about residue 2027 to about residue 3115.

```
SEQ ID NO: 13 Amino acid sequence of Rh1 (PlasmoDB
Accession No: PFD0110w)
MQRWIFCNIVLHILIYLAEFSHEQESYSSNEKIRKDYSDDNNYEPTPSYEKRKKEYGKDE

SYIKNYRGNNFSYDLSKNSSIFLHMGNGSNSKTLKRCNKKKNIKTNFLRPIEEEKTVLNN

YVYKGVNFLDTIKRNDSSYKFDVYKDTSFLKNREYKELITMQYDYAYLEATKEVLYLIPK

DKDYHKFYKNELEKILFNLKDSLKLLREGYIQSKLEMIRIHSDIDILNEFHQGNIINDNY

FNNEIKKKKEDMEKYIREYNLYIYKYENQLKIKIQKLTNEVSINLNKSTCEKNCYNYILK

LEKYKNIIKDKINKWKDLPEIYIDDKSFSYTFLKDVINNKIDIYKTISSFISTQKQLYYF

EYIYIMNKNTLNLLSYNIQKTDINSSSKYTYTKSHFLKDNHILLSKYYTAKFIDILNKTY

YYNLYKNKILLFNKYIIKLRNDLKEYAFKSIQFIQDKIKKHKDELSIENILQEVNNIYIK

YDTSINEISKYNNLIINTDLQIVQQKLLEIKQKKNDITHKVQLINHIYKNIHDEILNKKN

NEITKIIINNIKDHKKDLQDLLLFIQQIKQYNILTDHKITQCNNYYKEIIKMKEDINHIH

IYIQPILNNLHTLKQVQNNKIKYEEHIKQILQKIYDKKESLKKIILLKDEAQLDITLLDD

LIQKQTKKQTQTQTQTQKQTLIQNNETIQLISGQEDKHESNPFNHIQTYIQQKDTQNKNI
```

-continued

```
QNLLKSLYNGNINTFIDTISKYILKQKDIELTQHVYTDEKINDYLEEIKNEQNKIDKTID
DIKIQETLKQITHIVNNIKTIKKDLLKEFIQHLIKYMNERYQNMQQGYNNLTNYINQYEE
ENNNMKQYITTIRNIQKIYYDNIYAKEKEIRSGQYYKDFITSRKNIYNIRENISKNVDMI
KNEEKRKIQNCVDKYNSIKQYVKMLKNGDTQDENNNNNNDIYDKLIVPLDSIKQNIDKYN
TEHNFITFTNKINTHNKKNQEMMEEFIYAYKRLKILKILNISLKACEKNNKSINTLNDKT
QELKKIVTHEIDLLQKDILTSQISNKNVLLLNDLLKEIEQYIIDVHKLKKKSNDLFTYYE
QSKNYFYFKNKKDNFDIQKTINKMNEWLAIKNYINEINKNYQTLYEKKINVLLHNSKSYV
QYFYDHIINLILQKKNYLENTLKTKIQDNEHSLYALQQNEEYQKVKNEKDQNEIKKIKQL
IEKNKNDILTYENNIEQIEQKNIELKTNAQNKDDQIVNTLNEVKKKIIYTYEKVDNQISN
VLKNYEEGKVEYDKNVVQNVDADDTNDIDEINDIDEINDIDEINDIDEINDIDEIKDID
HIKHFDDTKHFDDIYHADDTRDEYHIALSNYIKTELRNINLQEIKNNIIKIFKEFKSAHK
EIKKESEQINKEFTKMDVVINQLRDIDRQMLDLYKELDEKYSEFNKTKIEEINNIRENIN
NVEIWYEKNIIEYFLRHMNDQKDKAAKYMENIDTYKNNIEIISKQINPENYVETLNKSNM
YSYVEKANDLFYKQINNIIINSNQLKNEAFTIDELQNIQKNRKNLLTKKQQIIQYTNEIE
NIFNEIKNINNILVLTNYKSILQDISQNINHVSIYTEQLHNLYIKLEEEKEQMKTLYHKS
NVLHNQINFNEDAFINNLLINIEKIKNDITHIKEKTNIYMIDVNKSKNNAQLYFHNTLRG
NEKIEYLKNLKSTNQQITLQELKQVQENVEKVKDIYNQTIKYEEEIKKNYHIITDYENK
INDILHNSFIKQINMESSNNKKQTKQIIDIINDKTFEEHIKTSKTKINMLKEQSQNKHID
KTLLNEQALKLFVDINSTNNNLDNMLSEINSIQNNIHTYIQEANKSFDKFKIICDQNVND
LLNKLSLGDLNYMNHLKNLQNEIRNMNLEKNFMLDKSKKIDEEEKKLDILKVNISNINNS
LDKLKKYYEEALFQKVKEKAEIQKENIEKIKQEINTLSDVFKKPFFFIQLNTDSSQHEKD
INNNVETYKNNIDEIYNVFIQSYNLIQKYSSEIFSSTLNYIQTKEIKEKSIKEQNQLNQN
EKEASVLLKNIKINETIKLFKQIKNERQNDVHNIKEDYNLLQQYLNYMKNEMEQLKKYKN
DVHMDKNYVENNNGEKEKLLKETISSYYDKINNINNKLYIYKNKEDTYFNNMIKVSEILN
IIIKKKQQNEQRIVINAEYDSSLINKDEEIKKEINNQIIELNKHNENISNIFKDIQNIKK
QSQDIITNMNDMYKSTILLVDIIQKKEEALNKQKNILRNIDNTLNKKENIIDKVIKCNCD
DYKDILIQNETEYQKLQNINHTYEEKKKSIDILKIKNIKQKNIQEYKNKLEQMNTIIQNS
IEQHVFINADILQNEKIKLEEIIKNLDILDEQIMTYHNSIDELYKLGIQCDNHLITTISV
VVNKNTTKIMIHIKKQKEDIQKINNYIQTNYNIINEEALQFHRLYGHNLISEDDKNNLVH
IIKEQKNIYTQKEIDISKIIKHVKKGLYSLNEHDMNHDTHMNIINEHINNNILQPYTQLI
NMIKDIDNVFIKIQNNKFEQIQKYIEIIKSLEQLNKNINTDNLNKLKDTQNKLINIETEM
KHKQKQLINKMNDIEKDNITDQYMHDVQQNIFEPITLKMNEYNTLLNDNHNNNINNEHQF
NHLNSLHTKIFSHNYNKEQQQEYITNIMQRIDVFINDLDTYQYEYYFYEWNQEYKQIDKN
KINQHINNIKNNLIHVKKQFEHTLENIKNNENIFDNIQLKKKDIDDIIININNTKETYLK
ELNKKKNVTKKKKVDEKSEINNHHTLQHDNQNVEQKNKIKDHNLITKPNNNSSEESHQNE
DMKEQNKNILEKQTRNIKPHHVHNHNHNHNQNQKDSTKLQEQDISTHKLHNTIHEQQSKD
NHQGNREKKQKNGNHERMYFASGIVVSILFLFSFGFVINSKNNKQEYDKEQEKQQQNDFV
CDNNKMDDKSTQKYGRNQEEVMEIFFDNDYI
```

The present invention includes a mutated form of SEQ ID NO:13. It is known to the skilled person that there are a large number of single nucleotide polymorphism in Rh1 and these and any other mutations are included within the scope of the invention.

Representative Rh1 sequences are disclosed in GenBank as follows: *Plasmodium falciparum* 3D7 normocyte-binding protein 1 (NBP1) gene): AF533700 (SEQ ID NO: 31), *Plasmodium falciparum* strain 7G8 normocyte-binding protein 1 (NBP1) gene: AF411933 (SEQ ID NO: 32), *Plasmodium falciparum* strain HB3 normocyte-binding protein 1 (NBP1) gene: AF411930 (SEQ ID NO: 33), *Plasmodium falciparum* strain Dd2 normocyte-binding protein 1 (NBP1) gene: AF411931 (SEQ ID NO: 34), *Plasmodium falciparum* strain FVO normocyte-binding protein 1 (NBP1) gene: AF411929 (SEQ ID NO: 35)

More particularly, the contiguous amino acid sequence may found in the region between about amino acid residue 1 to transmembrane domain of Rh1. The contiguous amino acid sequence may also be found in the region from about residue 1 to about residue 2897 of Rh1.

In one form of the immunogenic molecule, the Rh protein is Rh4, and the contiguous amino acid sequence is found in SEQ ID NO: 3 (PlasmoDB Accession No: PFD1150c), as disclosed below.

```
MNKNILWITFFYFLFFLLDMYQGNDAIPSKEKKNDPEADSKNSQNQHDINKTHHTNNNYD
LNIKDKDEKKRKNDNLINNYDYSLLKLSYNKNQDIYKNIQNGQKLKTDIILNSFVQINSS
NILMDEIENYVKKYTESNRIMYLQFKYIYLQSLNITVSFVPPNSPFRSYYDKNLNKDINE
TCHSIQTLLNNLISSKIIFKMLETTKEQILLLWNNKKISQQNYNQENQEKSKMIDSENEK
LEKYTNKFEHNIKPHIEDIEKKVNEYINNSDCHLTCSKYKTIINNYIDEIITTNTNIYEN
KYNLPQERIIKNYNHNGINNDDNFIEYNILNADPDLRSHFITLLVSRKQLIYIEYIYFIN
KHIVNKIQENFKLNQNKYIHFINSNNAVNAAKEYEYIIKYYTTFKYLQTLNKSLYDSIYK
HKINNYSHNIEDLINQLQHKINNLMIISFDKNKSSDLMLQCTNIKKYTDDICLSIKPKAL
EVEYLENINKHINKNEFLNKFMQNETFKKNIDDKIKEMNNIYDNTYIILKQKFLNKLNEI
IQNHKNKQETKLNTTTIQELLQLLKDTKEIQTKQIDTKINTFNMYYNDIQQIKIKINQNE
KEIKKVLPQLYIPKNEQEYIQIYKNELKDRIKETQTKINLFKQILELKEKEHYITNKHTY
LNFTHKTIQQILQQQYKNNTQEKNTLAQFLYNADIKKYIDELIPITQQIQTKMYTTNNIE
HIKQILINYIQECKPIQNISEHTIYTLYQEIKTNLENIEQKIMQNIQQTTNRLKINIKKI
FDQINQKYDDLTKNINQMNDEKIGLRQMENRLKGKYEEIKKANLQDRDIKYIVQNNDANN
NNNNIIINGNNQTGDYNHILFDYTHLWDNAQFTRTKENINNLKDNIQININNIKSIIRN
LQNELNNYNTLKSNSIHIYDKIHTLEELKILTQEINDKNVIRKIYDIETIYQNDLHNIEE
IIKNITSIYYKINILNILIICIKQTYNNNKSIESLKLKINNLTNSTQEYINQTKAIPTNL
LPEHIKQKSVSELNIYMKQIYDKLNEHVINNLYTKSKDSLQFYINEKNYNNNHDDHNDDH
NDVYNDIKENEIYKNNKLYECIQIKKDVDELYNIYDQLFKNISQNYNNHSLSFVHSINNH
HLSIFQDTKYGKHKNQQILSDIENIIKQNEHTESYKNLDTSNIQLIKEQIKYFLQIFHIL
QENITTFENQYKDLIIKMNHKINNNLKDITHIVINDNNTLQEQNRIYNELQNKIKQIKNV
SDVFTHNINYSQQILNYSQAQNSFFNIFMKFQNINNDINSKRYNVQKKITEIINSYDIIN
YNKNNIKDTYQQFKNIQQQLNTTETQLNHIKQNINHFKYFYESHQTISIVKNMQNEKLKI
QEFNKKIQHFKEETQIMINKLIQPSHIHLHKMKLPITQQQLNTILHRNEQTKNATRSYNM
NEEENEMGYGITNKRKNSETNDMINTTIGDKTNVLKNDDQEKGKRGTSRNNNIHTNENNI
NNEHTNENNINNEHTNEKNINNEHANEKNIYNEHTNENNINYEHPNNYQQKNDEKISLQH
KTINTSQRTIDDSNMDRNNRYNTSSQQKNNLHTNNNSNSRYNNNHDKQNEHKYNQGKSSG
KDNAYYRIFYAGGITAVLLLCSSTAFFFIKNSNEPHHIFNIFQKEFSEADNAHSEEKEEY
LPVYFDEVEDEVEDEVEDEDENENEVENENEDFNDI
```

The present invention includes a mutated form of SEQ ID NO:3. Mutations that are included within the scope of the invention include those whereby Y at amino acid 12 is replaced with A, L at amino acid 143 is replaced with I, N at amino acid 435 is replaced with K, Q at amino acid 438 is replaced with K, T at amino acid 506 replaced with K, N at amino acid 771 is replaced with S, N at amino acid 844 is replaced with I, K at amino acid 1482 is replaced with R, or N at amino acid 1498 is replaced with I.

Representative Rh4 sequences are disclosed in GenBank as follows: *Plasmodium falciparum* clone 3D7B reticulocyte binding protein homolog 4 (rh4): AF432854 (SEQ ID NO: 36), *Plasmodium falciparum* clone Dd2 reticulocyte binding protein-like protein 4 (rh4) gene: AF420309 (SEQ ID NO: 37).

More particularly, the contiguous amino acid sequence is found in the region from about the MTH1187/YkoF-like superfamily domain to about the transmembrane domain of Rh4.

In another form of the immunogenic molecule, the contiguous amino acid sequence is found in the region from about residue 1160 to about residue 1370 of Rh4.

In a further form of the molecule, the contiguous amino acid sequence is found in the region from about residue 28 to about residue 766. In another form of the molecule, the continuous amino acid sequence is found in the region from about residue 282 to about 642. In a further form of the molecule, the contiguous amino acid sequence is found in the region from about residue 233 to about residue 540. In another form of the molecule, the contiguous amino acid sequence is found in the region from about residue 28 to about residue 340. In a further form of the molecule the continuous amino acid sequence is found in the region from about residue 1277 to about residue 1451. In another form of the molecule the continuous amino acid sequence is found in the region from about residue 29 to about residue 766.

In the compositions of the present invention the following combinations of EBA and Rh molecules are particularly preferred: (i) EBA175 and Rh2 (2a or 2b), (ii) EBA175 and EBA140 and Rh2 (2a or 2b), and (iii) EBA175 and Rh1 and Rh2. The combinations defined at (i), (ii) and (iii) may also be further combined with an Rh4 molecule and/or an EBA181 molecule. It is to be understood that the entire EBA or Rh molecules are not required, and that any of the fragments of these molecules as described herein may be used. Furthermore, a contiguous amino acid sequence of about 5 or more, about 8 or more, about 10 or more, about 20 or more, about 50 or more, or about 100 or more amino acids may be used. In one example, the contiguous amino acid sequences are from 20-50 amino acids, 20-100 amino acids or 20-200 amino acids in length.

Based on results presented herein, Applicant proposes that a broad inhibitory response against functional epitopes of invasion ligands may be needed to convey substantial protective immunity. It is proposed that vaccines should preferably target multiple invasion ligands in order to be fully effective and ameliorate parasite immune evasion strategies. An effective vaccine may include ligands involved in both SA-dependent and SA-independent invasion. In light of this, it will still be appreciated that immune responses against only single ligands will nonetheless be useful.

Similarly, the skilled person understands that strict compliance with any amino acid sequence disclosed herein is not necessarily required, and he or she could decide by a matter of routine whether any further mutation is deleterious or preferred. Thus, the immunogenic molecules of the present invention include sequences having 50% or more identity (e.g. 60%, 65%, 70%, 75%, 80%, 85%, 90%, 91%, 92%, 93%, 94%, 95%, 96%, 97%, 98%, 99%, 99.5% or more) to any protein disclosed herein. The immunogenic molecules also include variants (e.g. allelic variants, homologs, orthologs, paralogs, mutants, etc.). The molecules may lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus.

Some forms of the composition contain more than one EBA-derived immunogenic molecule, or more than one Rh-derived immunogenic molecule. The composition may contain any combination of two or more immunogenic molecules derived from Rh1, Rh2a, Rh2b and Rh4. The composition may contain any combination of two or more immunogenic molecules derived from EBA175, EBA140 and EBA181. It is further contemplated that any combination of Rh-derived immunogenic molecules with EBA-derived immunogenic molecules may be present in the composition.

As alluded to by the aforementioned disclosure, the invention further provides a composition of the invention for use as a medicament. Accordingly, in a further aspect the present invention provides a method of treating or preventing a condition caused by or associated with infection by *Plasmodium falciparum* comprising administering to a subject in need thereof an effective amount of a composition as described herein. The medicament is a malarial vaccine in one form of the composition.

Vaccines according to the present invention may either be prophylactic (i.e. to prevent infection) or therapeutic (i.e. to treat infection), but will typically be prophylactic. Accordingly, the invention includes a method for the therapeutic or prophylactic treatment of *Plasmodium falciparum* infection in an animal susceptible to *Plasmodium falciparum* infection comprising administering to said animal a therapeutic or prophylactic amount of the immunogenic compositions of the invention.

The compositions of the invention may elicit both a cell mediated immune response as well as a humoral immune response in order to effectively address a *Plasmodium* intracellular infection. This immune response will preferably induce long lasting antibodies and a cell mediated immunity that can quickly respond upon exposure to *Plasmodium*.

Two types of T cells, CD4 and CD8 cells, are generally thought necessary to initiate and/or enhance cell mediated immunity and humoral immunity. CD8 T cells can express a CD8 co-receptor and are commonly referred to as Cytotoxic T lymphocytes (CTLs). CD8 T cells are able to recognized or interact with antigens displayed on MHC Class I molecules.

CD4 T cells can express a CD4 co-receptor and are commonly referred to as T helper cells. CD4 T cells are able to recognize antigenic peptides bound to MHC class II molecules. Upon interaction with a MHC class II molecule, the CD4 cells can secrete factors such as cytokines. These secreted cytokines can activate B cells, cytotoxic T cells, macrophages, and other cells that participate in an immune response. Helper T cells or CD4+ cells can be further divided into two functionally distinct subsets: TH1 phenotype and TH2 phenotypes which differ in their cytokine and effector function.

Activated TH1 cells enhance cellular immunity (including an increase in antigen-specific CTL production) and are therefore of particular value in responding to intracellular infections. Activated TH1 cells may secrete one or more of IL-2, IFN-gamma, and TNF-beta. A TH1 immune response may result in local inflammatory reactions by activating macrophages, NK (natural killer) cells, and CD8 cytotoxic T cells (CTLs). A TH1 immune response may also act to expand the immune response by stimulating growth of B and T cells with IL-12. TH1 stimulated B cells may secrete IgG2a.

Activated TH2 cells enhance antibody production and are therefore of value in responding to extracellular infections. Activated TH2 cells may secrete one or more of IL-4, IL-5, IL-6, and IL-10. A TH2 immune response may result in the production of IgGI. IgE, IgA and memory B cells for future protection.

An enhanced immune response may include one or more of an enhanced TH1 immune response and a TH2 immune response.

An enhanced TH1 immune response may include one or more of an increase in CTLs, an increase in one or more of the cytokines associated with a TH1 immune response (such as IL-2, IFN-gamma, and TNF-beta), an increase in activated macrophages, an increase in NK activity, or an increase in the production of IgG2a. Preferably, the enhanced TH1 immune response will include an increase in IgG2a production.

A TH1 immune response may be elicited using a TH1 adjuvant. A TH1 adjuvant will generally elicit increased levels of IgG2a production relative to immunization of the antigen without adjuvant. TH1 adjuvants suitable for use in the invention may include for example saponin formulations, virosomes and virus like particles, nontoxic derivatives of enterobacterial lipopolysaccharide (LPS), immunostimulatory oligonucleotides. Immunostimulatory oligonucleotides, such as oligonucleotides containing a CpG motif, are preferred TH1 adjuvants for use in the invention.

An enhanced TH2 immune response may include one or more of an increase in one or more of the cytokines associated with a TH2 immune response (such as IL-4, IL-5, IL-6 and IL-10), or an increase in the production of IgGI, IgE, IgA and memory B cells. Preferably, the enhanced TH2 immune response will include an increase in IgGI production.

A TH2 immune response may be elicited using a TH2 adjuvant. A TH2 adjuvant will generally elicit increased levels of IgGI production relative to immunization of the antigen without adjuvant. TH2 adjuvants suitable for use in the invention include, for example, mineral containing compositions, oil-emulsions, and ADP-ribosylating toxins and detoxified derivatives thereof. Mineral containing compositions, such as aluminium salts are preferred TH2 adjuvants for use in the invention.

Preferably, the invention includes a composition comprising a combination of a TH1 adjuvant and a TH2 adjuvant. Preferably, such a composition elicits an enhanced TH1 and an enhanced TH2 response, i.e., an increase in the production of both IgGI and IgG2a production relative to immunization without an adjuvant. Still more preferably, the composition comprising a combination of a TH1 and a TH2 adjuvant elicits an increased TH1 and/or an increased TH2 immune response relative to immunization with a single adjuvant (i.e., relative to immunization with a TH1 adjuvant alone or immunization with a TH2 adjuvant alone).

The immune response may be one or both of a TH1 Immune response and a TH2 response. Preferably, immune response provides for one or both of an enhanced TH1 response and an enhanced TH2 response. The TH1/TH2 response in mice may be measured by comparing IgG2a and IgGI titres, while the TH1/TH2 response in man may be measured by comparing the levels of cytokines specific for the two types of response (e.g. the IFN-γ/IL-4 ratio).

In one form of the method of treatment or prevention the subject is a human. The human may be an infant, a child, an adolescent, or an adult. Use of the vaccine may be especially important in women in child-bearing years. Pregnant women, particularly in the second and third trimesters of pregnancy are more likely to develop severe malaria than other adults, often complicated by pulmonary oedema and hypoglycaemia. Maternal mortality is approximately 50%, which is higher than in non-pregnant adults. Fetal death and premature labor are common.

One way of monitoring vaccine efficacy for therapeutic treatment involves monitoring *Plasmodium falciparum* infection after administration of the compositions of the invention. One way of checking efficacy of prophylactic treatment involves monitoring immune responses systemically (such as monitoring the level of IgGI and IgG2a production) against the *Plasmodium* antigens in the compositions of the invention after administration of the composition. Serum *Plasmodium* specific antibody responses may be determined post-immunisation and post-challenge.

The uses and methods are for the prevention and/or treatment of a disease caused by *Plasmodium* (e.g. malaria) and/or its clinical manifestations (e.g. prostration, impaired consciousness, respiratory distress (acidotic breathing), multiple convulsions, circulatory collapse, pulmonary oedema (radiological), abnormal bleeding, jaundice, haemoglobinuria, etc.).

The compositions of the present invention can be evaluated in in vitro and in vivo animal models prior to host, e.g., human, administration. For example, in vitro neutralization an/or invasion inhibition is suitable for testing vaccine compositions (such as immunogenic/immuno protective compositions) directed toward *Plasmodium*.

Reaction to the vaccine may be evaluated in vitro and in vivo following host e.g. human, administration. For example, response to vaccine compositions may examined by Enzyme-Linked ImmunoSorbent Assay (ELISA). For example, ELISA may be conducted as follows: Plates (e.g. flat-bottomed microtiter plates (Maxisorp from Nunc A/S or High Binding from Costar, Cat. No. 3590) may be coated with 50 µL of peptide solution or crude parasite antigen at 10 µg/mL in coating buffer. Keep the plate at 4° C. overnight. With many proteins or peptides, PBS can be used as a coating solution. Block with 100 µL of 0.5% BSA in coating buffer for 3 to 4 h at 37° C. Wash 4 times with 0.9% NaCl plus 0.05% Tween. Add 50 µL of serum samples diluted 1:1000; leave them for 1 h at 37° C. Wash 4 times with 0.9% NaCl plus 0.05% Tween. Add 50 µL of ALP-conjugated or biotinylated anti-Ig of appropriate specificity at the recommended concentration in Tween-buffer; leave for 1 h at 37° C. Wash the sample 4 times with 0.9% NaCl plus 0.05% Tween. If biotinylated antibody has been used, add 50 µL of streptavidin-ALP diluted 1:2000 in Tween-buffer; leave the sample for 1 h at 37° C. Wash the sample 4 times with 0.9% NaCl plus 0.05% Tween. Develop the sample with 50 µL of NPP (1 tablet/5 mL of substrate buffer) and read at $OD_{405}$.

Infection may be established using typical signs and symptoms of malaria. The signs and symptoms of malaria, such as fever, chills, headache and anorexia. Preferably, more specific methods of diagnosis are preferred e.g. using a scoring matrix of clinical symptoms, light microscopy which allows quantification of malaria parasites (e.g. thick or thin film blood smears from patients stained with acridine orange or Giemsa, rapid diagnostic tests (e.g. immunochromatographic tests that detect parasite-specific antigens e.g. HRP2, parasite lactate dehydrogenase (pLDH), aldolase etc) in a finger-prick blood sample, and polymerase-chain reaction.

Vaccine efficacy may be measured e.g. by examining the number and frequency of cases of malaria (e.g. asexual *Plasmodium falciparum* at any level plus a temperature greater than or equal to 37.5° C. and headache, myalgia, arthralgia, malaise, nausea, dizziness, or abdominal pain), time to first infection with *Plasmodium falciparum*, parasitemia, geometric mean parasite density in first clinical episode, adverse events, anaemia (measured by for example packed cell volume less than 25% or less than 15%), absence of parasites at the end of immunization, proportion of individuals with seroconversion to the antigens of the present invention at e.g. day 75 post immunization, proportion with "efficacious seroconversion" to the antigens of the present invention (4-fold elevation in antibody titre) at day 75, number of symptomatic *Plasmodium falciparum* cases after 1, 2, or 3 doses, number of days until *Plasmodium falciparum* positive blood slide, density of *Plasmodium falciparum*, prevalence of *Plasmodium falciparum, Plasmodium vivax*, and *Plasmodium malariae*, levels of anti-Rh or anti-EBA (e.g. Rh1, Rh2, Rh4, EBA175, EBA181, EBA140 etc.) antibody by ELISA, geometric mean parasite density in first clinical episode, lymphocyte proliferation to Rh or EBA (e.g. Rh1, Rh2, Rh4, EBA17S, EBA181, EBA140 etc.) T-cell responses to antigen frequency of fever, malaise, nausea, Malaria requiring hospital admission, cerebral malaria (e.g. Blantyre coma score <2) etc.

The vaccine may be administered using a variety of vaccination regimes familiar to the skiller person. In one form of the invention, the vaccine composition may be administered post antimalarial treatment. Preferred antimalarials for use include the chloroquine phosphate, proguanil, primaquine, doxycycline, mefloquine, clindamycin, halofantrine, quinine sulphate, quinine dihydrochloride, gluconate, primaquine phosphate and sulfadoxine. For example, blood stage parasitaemia may be cleared with Fansidar (25 mg sulfadoxine/0.75 mg pyrimethamine per kg body weight) before each vaccination. In another form of the invention antimalarial (e.g. Fansidar) treatment is given 1 to 2 weeks before the doses (e.g. first and third doses). In another form of the invention antimalarial (e.g. Fansidar) treatment is given before the first dose.

In another form of the invention, 3 doses of vaccine composition (e.g. 0.5 mg adsorbed onto 0.312 g alum in 0.125 mL) is administered in 3 doses, 2 mg per dose to >5 year olds, 1 mg to under 5 year olds, at weeks 0, 4, and 25. In another form of the invention, 3 doses of vaccine composition (e.g. 1 mg per dose) are given subcutaneously at weeks 0, 4, and 26. In another form of the invention, 3 doses of vaccine composition is administered on days 0, 30, and 180 at different doses (e.g. 1 mg; 0.5 mg). In another form of the invention, 3 doses of vaccine composition is administered at 3 to 4 month intervals either intramuscularly or subcutaneously. In another form of the invention 3 doses of vaccine composition is administered subcutaneously on days 0, 30, and about day 180. In another form of the invention, the vaccine composition is administered in 2 doses at 4-week intervals (e.g. 0.55 mL per dose containing 4 µg or 15 µg or 13.3 µg of each antigen). In another form of the invention, 3 doses of the vaccine composition is administered (e.g. 25 µg in 250 µL AS02A adjuvant) intramuscularly in deltoid (in alternating arms) at 0, 1, and 2 months. In another form of the invention 4 doses of the vaccine composition is given (e.g. 50 µg per 0.5 mL dose) on days 0, 28, and 150; and dose 4 given in the following year. In another form of the invention, where the vaccine is a DNA vaccine, the vaccine composition is administered in two doses (e.g. 2 mg on days 0 and 21 (2 intramuscular injections each time, 1 into each deltoid muscle). In another form of the invention, where the vaccine composition comprises an immunogenic molecule covalently linked to another molecule (e.g. *Pseudomonas aeruginosa* toxin A) the composition is administered in 3 doses (e.g. at 1, 8, and 24 weeks).

The present invention may be used to generate invasion-inhibitory antibodies useful as in vitro diagnostic reagents, or as therapeutics for passive immunization. The term "antibody" includes intact immunoglobulin molecules, as well as fragments thereof which are capable of binding an antigen. These include hybrid (chimeric) antibody molecules; F(ab')2 and F(ab) fragments and Fv molecules; non-covalent heterodimers; single-chain Fv molecules (sFv); dimeric and trimeric antibody fragment constructs; minibodies; humanized antibody molecules; and any functional fragments obtained from such molecules, as well as antibodies obtained through non-conventional processes such as phage display. Preferably, the antibodies are monoclonal antibodies. Methods of obtaining monoclonal antibodies are well known in the art.

Various immunoassays (e.g., Western blots, ELISAs, radioimmunoassays, immunohistochemical assays, immunoprecipitations, invasion-inhibition assays, or other immunochemical assays known in the art) can be used to identify antibodies having the desired specificity. Numerous protocols for competitive binding or immunoradiometric assays are well known in the art. Such immunoassays typically involve the measurement of complex formation between an immunogen and an antibody which specifically binds to the immunogen. A preparation of antibodies which specifically bind to a particular antigen typically provides a detection signal at least 5-, 10-, or 20-fold higher than a detection signal provided with other proteins when used in an immunochemical assay. Preferably, the antibodies do not detect other proteins in immunochemical assays and can inimunoprecipitate the particular antigen from solution.

The surface-exposed antigens of the invention can be used to immunize a mammal, such as a mouse, rat, rabbit, guinea pig, monkey, or human, to produce polyclonal antibodies. If desired, an antigen can be conjugated to a carrier protein, such as bovine serum albumin, thyroglobulin, and keyhole limpet hemocyanin. Depending on the host species, various adjuvants can be used to increase the immunological response. Such adjuvants include those described above, as well as those not used in humans, for example, Freund's adjuvant.

Monoclonal antibodies which specifically bind to an antigen can be prepared using any technique which provides for the production of antibody molecules by continuous cell lines in culture. These techniques include, but are not limited to, the hybridoma technique, the human B-cell hybridoma technique, and the EBV-hybridoma technique.

In addition, techniques developed for the production of "chimeric antibodies," the splicing of mouse antibody genes to human antibody genes to obtain a molecule with appropriate antigen specificity and biological activity, can be used. Monoclonal and other antibodies also can be "humanized" to prevent a patient from mounting an immune response against the antibody when it is used therapeutically. Such antibodies may be sufficiently similar in sequence to human antibodies to be used directly in therapy or may require alteration of a few key residues. Sequence differences between rodent antibodies and human sequences can be minimized by replacing residues which differ from those in the human sequences by site directed mutagenesis of individual residues or by grating of entire complementarity determining regions.

Alternatively, humanized antibodies can be produced using recombinant methods, as described below. Antibodies which specifically bind to a particular antigen can contain antigen binding sites which are either partially or fully humanized.

Alternatively, techniques described for the production of single chain antibodies can be adapted using methods known in the art to produce single chain antibodies which specifically bind to a particular antigen. Antibodies with related specificity, but of distinct idiotypic composition, can be generated by chain shuffling from random combinatorial immunoglobin libraries.

Single-chain antibodies also can be constructed using a DNA amplification method, such as PCR, using hybridoma cDNA as a template. Single-chain antibodies can be mono- or bispecific, and can be bivalent or tetravalent.

A nucleotide sequence encoding a single-chain antibody can be constructed using manual or automated nucleotide synthesis, cloned into an expression construct using standard recombinant DNA methods, and introduced into a cell to express the coding sequence, as described below. Alternatively, single-chain antibodies can be produced directly using, for example, filamentous phage technology.

Antibodies which specifically bind to a particular antigen also can be produced by inducing in vivo production in the lymphocyte population or by screening immunoglobulin libraries or panels of highly specific binding reagents.

Chimeric antibodies can be constructed. Binding proteins which are derived from immunoglobulins and which are multivalent and multispecific, such as "diabodies" can also be prepared.

Antibodies can be purified by methods well known in the art. For example, antibodies can be affinity purified by passage over a column to which the relevant antigen is bound. The bound antibodies can then be eluted from the column using a buffer with a high salt concentration.

In another aspect the present invention provides use of a composition described herein in the manufacture of a medicament for the treatment or prevention of a condition caused by or associated with infection by *Plasmodium falciparum*.

A further aspect of the invention provides a method of screening for the presence of a *Plasmodium falciparum* invasion-inhibitory antibody directed against a reticulocyte-binding homologue protein (Rh) of a strain of *Plasmodium falciparum* in a subject, comprising obtaining a biological sample from the subject and identifying the presence or absence of an antibody capable of binding to an immunogenic molecule as described herein. The method may further comprise identifying the presence of a *Plasmodium falciparum* invasion-inhibitory antibody directed against an erythrocyte binding antigen (EBA) of a strain of *Plasmodium falciparum* in a subject comprising identifying the presence or absence of an antibody capable of binding to an immunogenic molecule as described herein.

The invention also provides nucleic acid encoding a polypeptide immunogenic molecule of the invention. The nucleotide sequence of Rh2b is given below (SEQ ID NO: 2)

```
ATGAAGAGATCGCTTATAAATTTAGAAAATGATCTTTTTAGATTAGAACCTATATCTTAT
ATTCAAAGAATATTATAAGAAGAATATAAACAGATCTGATATTTTTCATAATAAAAAGAA
AGAGGTTCCAAAGTATATTCAAATGTGTCTTCATTCCATTCTTTTATTCAAGAGGGTAAA
GAAGAAGTTGAGGTTTTTTCTATATGGGGTAGTAATAGCGTTTTAGATCATATAGATGTT
CTTAGGGATAATGGAACTGTCGTTTTTTCTGTTCAACCATATTACCTTGATATATATACG
TGTAAAGAAGCCATATTATTTACTACATCATTTTACAAGGATCTTGATAAAAGTTCAATT
ACAAAAATTAATGAAGATATTGAAAAATTTAACGAAGAAATAATCAAGAATGAAGAACAA
TGTTTAGTTGGTGGGAAAACAGATTTTGATAATTTACTTATAGTTTTAGAAAATGCGGAA
AAAGCAAATGTTAGAAAAACATTATTTGATAATACATTTAATGATTATAAAAATAAGAAA
TCTAGTTTTTACAATTGTTTGAAAAATAAAAAAAATGATTATGATAAGAAAATAAAGAAT
ATAAAGAATGAGATTACAAATTGTTAAAAAATATTGAAAGTACAGGAAATATGTGTAAA
ACGGAATCATATGTTATGAATAATAATTTATATCTATTAAGAGTGAATGAAGTTAAAAGT
ACACCTATTGATTTATACTTAAATCGAGCAAAAGAGCTATTAGAATCAAGTAGCAAATTA
GTTAATCCTATAAAAATGAAATTAGGTGATAATAAGAACATGTACTCTATTGGATATATA
CATGACGAAATTAAAGATATTATAAAAAGATATAATTTTCATTTGAAACATATAGAAAAA
GGAAAAGAATATATAAAAAGGATAACACAAGCAAATAATATTGGAGACAAAATGAAGAAA
GATGAACTTATAAAAAAATTTTTGAATCCTCAAAACATTTTGCTAGTTTTAAATATAGC
AATGAAATGATAAGCAAATTAGATTCGTTATTTATAAAAAATGAAGAAATACTTAATAAT
TTATTCAATAATATATTTAATATATTCAAGAAAAAATATGAAACATATGTAGATATGAAA
ACAATTGAATCTAAATATACAACAGTAATGACTCTATCAGAACATTTATTAGAATATGCA
ATGGATGTTTTAAAAGCTAACCCTCAAAAACCTATTGATCCAAAAGCAAATCTGGATTCA
GAAGTAGTAAAATTACAAATAAAAATAAATGAGAAATCAAATGAATTAGATAATGCTATA
AGTCAAGTAAAAACACTAATAATAATAATGAAATCATTTTATGATATTATTATATCTGAA
AAAGCCTCTATGGATGAAATGGAAAAAAAGGAATTATCCTTAAATAATTATATTGAAAAA
```

-continued

```
ACAGATTATATATTACAAACGTATAATATTTTTAAGTCTAAAAGTAATATTATAAATAAT

AATAGTAAAAATATTAGTTCTAAATATATAACTATAGAAGGGTTAAAAAATGATATTGAT

GAATTAAATAGTCTTATATCATATTTTAAGGATTCACAAGAAACATTAATAAAGATGAT

GAATTAAAAAAAAACATGAAAACGGATTATCTTAATAACGTGAAATATATAGAAGAAAT

GTTACTCATATAAATGAAATTATATTATTAAAAGATTCTATAACTCAACGAATAGCAGAT

ATTGATGAATTAAATAGTTTAAATTTAATAAATATAAATGATTTTATAAATGAAAAGAAT

ATATCACAAGAGAAAGTATCATATAATCTTAATAAATTATATAAAGGAAGTTTTGAAGAA

TTAGAATCTGAACTATCTCATTTTTTAGACACAAAATATTTGTTTCATGAAAAAAAAAGT

GTAAATGAACTTCAAACAATTTTAAATACATCAAATAATGAATGTGCTAAATTAAATTTT

ATGAAATCTGATAATAATAATAATAATAATAATAGTAATATAATTAACTTGTTAAAAACT

GAATTAAGTCATCTATTAAGTCTTAAAGAAAATATAATAAAAAAACTTTTAAATCATATA

GAACAAAATATTCAAAACTCATCAAATAAGTATACTATTACATATACTGATATTAATAAT

AGAATGGAAGATTATAAAGAAGAAATCGAAACTTTAGAAGTATATAAACATACCATTGGA

AATATACAAAAGAATATATATTACATTTATATGAGAATGATAAAAATGCTTTAGCTGTA

CATAATACATCAATGCAAATATTACAATATAAAGATGCTATACAAAATATAAAAAATAAA

ATTTCTGATGATATAAAAATTTTAAAGAAATATAAAGAAATGAATCAAGATTTATTAAAT

TATTATGAAATTCTAGATAAAAAATTAAAAGATAATACATATATCAAAGAAATGCATACT

GCTTCTTTAGTTCAAATAACTCAATATATTCCTTATGAAGATAAAACAATAAGTGAACTT

GAGCAAGAATTTAATAATAATAATCAAAAACTTGATAATATATTACAAGATATCAATGCA

ATGAATTTAAATATAAATATTCTCCAAACCTTAAATATTGGTATAAATGCATGTAATACA

AATAATAAAAATGTAGAACACTTACTTAACAAGAAAATTGAATTAAAAAATATATTAAAT

GATCAAATGAAAATTATAAAAAATGATGATATAATTCAAGATAATGAAAAGAAACTTT

TCAAATGTTTTAAAAAAAGAAGAGGAAAAATTAGAAAAAGAATTAGATGATATCAAATTT

AATAATTTGAAAATGGACATTCATAAATTGTTGAATTCGTATGACCATACAAAGCAAAAT

ATAGAAAGCAATCTTAAAATAAATTTAGATTCTTTCGAAAAGGAAAAAGATAGTTGGGTT

CATTTTAAAAGTACTATAGATAGTTTATATGTGGAATATAACATATGTAATCAAAAGACT

CATAATACTATCAAACAACAAAAAAATGATATCATAGAACTTATTTATAAACGTATAAAA

GATATAAATCAACAAATAATCGAAAAGGTAGATAATTATTATTCCCTGTCAGATAAAGCC

TTAACTAAACTTAAATCTATTCATTTTAATATTGATAAGGAAAAATATAAAAATCCCAAA

AGTCAAGAAATATTAAATTATTAGAAGATAGAGTTATGATACTTGAGAAAAAGATTAAG

GAAGATAAAGATGCTTTAATACAAATTAAGAATTTATCACATGATCATTTTGTAAATGCT

GATAATGAGAAAAAAAGCAGAAGGAGAAGGAGGAGGACGACGAACAAACACACTATAGT

AAAAAAAGAAAGTAATGGGAGATATATATAAGGATATTAAAAAAAACCTAGATGAGTTA

AATAATAAAAATTTGATAGATATTACTTTAAATGAAGCAAATAAAATAGAATCAGAATAT

GAAAAAATATTAATTGATGATATTTGTGAACAAATTACAAATGAAGCAAAAAAAGTGAT

ACTATTAAGGAAAAAATCGAATCATATAAAAAAGATATTGATTATGTAGATGTGGACGTT

TCCAAAACGAGGAACGATCATCATTTGAATGGAGATAAAATACATGATTCTTTTTTTTAT

GAAGATACATTAAATTATAAAGCATATTTTGATAAATTAAAAGATTTATATGAAAATATA

AACAAGTTAACAAATGAATCAAATGGATTAAAAAGTCATGCTCATAATAACAACACACAA

GTTGATAAACTAAAAGAAATTAATTTACAAGTATTCAGCAATTTAGGAAATATAATTAAA

TATGTTGAAAAACTTGAGAATACATTACATGAACTTAAAGATATGTACGAATTTCTAGAA
```

-continued

```
ACGATCGATATTAATAAAATATTAAAAAGTATTCATAATAGCATGAAGAAATCAGAAGAA
TATAGTAATGAAACGAAAAAAATATTTGAACAATCAGTAAATATAACTAATCAATTTATA
GAAGATGTTGAAATATTGAAAACGTCTATTAACCCAAACTATGAAAGCTTAAATGATGAT
CAAATTGATGATAATATAAAATCACTTGTTCTAAAGAAAGAGGAAATATCCGAAAAAGA
AAACAAGTGAATAAATACATAACAGATATTGAATCTAATAAAGAACAATCAGATTTACAT
TTACGATATGCATCTAGAAGTATATATGTTATTGATCTTTTTATAAAACATGAAATAATA
AATCCTAGCGATGGAAAAAATTTTGATATTATAAAGGTTAAAGAAATGATAAATAAACC
AAACAAGTTTCAAATGAAGCTATGGAATATGCTAATAAAATGGATGAAAAAAATAAGGAC
ATTATAAAAATAGAAAATGAACTTTATAATTTAATTAATAATAACATCCCTTCATTAAAA
GGGGTAAAATATGAAAAGTTAGGAAACAAGCAAGAAATGCAATTGATGATATAAATAAT
ATACATTCTAATATTAAAACGATTTTAACCAAATCTAAAGAACGATTAGATGAGATTAAG
AAACAACCTAACATTAAAAGAGAAGGTGATGTTTTAAATAATGATAAAACCAAAATAGCT
TATATTACAATACAAATAAATAACGGAAGAATAGAATCTAATTTATTAAATATATTAAAT
ATGAAACATAACATAGATACTATCTTGAATAAAGCTATGGATTATATGAATGATGTATCA
AAATCTGACCAGATTGTTATTAATATAGATTCTTTGAATATGAACGATATATATAATAAG
GATAAAGATCTTTTAATAAATATTTTAAAAGAAAAACAGAATATGGAGGCAGAATATAAA
AAAATGAATGAAATGTATAATTACGTTAATGAAACAGAAAAGAAATAATAAAACATAAA
AAAAATTATGAAATAAGAATTATGGAACATATAAAAAAAGAAACAAATGAAAAAAAAAA
AAATTTATGGAATCTAATAACAAATCATTAACTACTTTAATGGATTCATTCAGATCTATG
TTTTATAATGAATATATAAATGATTATAATATAAATGAAAATTTTGAAAAACATCAAAAT
ATATTGAATGAAATATATAATGGATTTAATGAATCATATAATATTATTAATACAAAAATG
ACTGAAATTATAAATGATAATTTAGATTATAATGAAATAAAAGAAATTAAAGAAGTAGCA
CAAACAGAATATGATAAACTTAATAAAAAAGTTGATGAATTAAAAAATTATTTGAATAAT
ATTAAAGAACAAGAAGGACATCGATTAATTGATTATATAAAAGAAAAAATATTTAACTTA
TATATAAAATGTTCAGAACAACAAAATATAATAGATGATTCTTATAATTATATTACAGTT
AAAAAACAGTATATTAAAACTATTGAAGATGTGAAATTTTTATTAGATTCATTGAACACA
ATAGAAGAAAAAATAAATCAGTAGCAAATCTAGAAATTTGTACTAATAAAGAAGATATA
AAAAATTTACTTAAACATGTTATAAAGTTGGCAAATTTTTCAGGTATTATTGTAATGTCT
GATACAAATACGGAAATAACTCCAGAAAATCCTTTAGAAGATAATGATTTATTAAATTTA
CAATTATATTTTGAAAGAAAACATGAAATAACATCAACATTGGAAAATGATTCTGATTTA
GAGTTAGATCATTTAGGTAGTAATTCGGATGAATCTATAGATAATTTAAAGGTTTATAAT
GATATTATAGAATTACACACATATTCAACACAAATTCTTAAATATTTAGATAATATTCAA
AAACTTAAAGGAGATTGCAATGATTTAGTAAAGGATTGTAAAGAATTACGTGAATTGTCT
ACGGCATTATATGATTTAAAAATACAAATTACTAGTGTAATTAATAGAGAAAATGATATT
TCAAATAATATTGATATTGTATCTAATAAATTAAATGAAATAGATGCTATACAATATAAT
TTTGAAAAATATAAAGAAATTTTTGATAATGTAGAAGAATATAAAACATTAGATGATACA
AAAAATGCATATATTGTAAAAAAGGCTGAAATTTTAAAAAATGTAGATATAAATAAAACA
AAAGAAGATTTAGATATATATTTTAATGACTTAGACGAATTAGAAAAATCTCTTACATTA
TCATCTAATGAAATGGAAATTAAAACAATAGTACAGAACTCATATAATTCCTTTTCTGAT
ATTAATAAGAACATTAATGATATTGATAAAGAAATGAAAACACTGATCCCTATGCTTGAT
```

-continued
GAATTATTAAATGAAGGACATAATATTGATATATCATTATATAATTTTATAATTAGAAAT

ATTCAGATTAAAATAGGTAATGATATAAAAAATATAAGAGAACAGGAAAATGATACTAAT

ATATGTTTTGAGTATATTCAAAATAATTATAATTTTATAAAGAGTGATATAAGTATCTTC

AATAAATATGATGATCATATAAAAGTAGATAATTATATATCTAATAATATTGATGTTGTC

AATAAACATAATAGTTTATTAAGTGAACATGTTATAAATGCTACAAATATTATAGAGAAT

ATTATGACAAGTATTGTCGAAATAAATGAAGATACAGAAATGAATTCTTTAGAAGAGACA

CAAGACAAATTATTAGAACTATATGAAAATTTTAAGAAAGAAAAAAATATTATAAATAAT

AATTATAAAATAGTACATTTTAATAAATTAAAAGAAATAGAAAATAGTTTAGAGACATAT

AATTCAATATCAACAAACTTTAATAAAATAAATGAAACACAAAATATAGATATTTTAAAA

AATGAATTTAATAATATCAAAACAAAAATTAATGATAAAGTAAAAGAATTAGTTCATGTT

GATAGTACATTAACACTTGAATCAATTCAAACGTTTAATAATTTATATGGTGACTTGATG

TCTAATATACAAGATGTATATAAATATGAAGATATTAATAATGTTGAATTGAAAAAGGTG

AAATTATATATAGAAAATATTACAAATTTATTAGGAAGAATAAACACATTCATAAAGGAG

TTAGACAAATATCAGGATGAAAATAATGGTATAGATAAGTATATAGAAATCAATAAGGAA

AATAATAGTTATATAATAAAATTGAAAGAAAAAGCCAATAATCTAAAGGAAAATTTCTCA

AAATTATTACAAAATATAAAAAGAAATGAAACTGAATTATATAATATAAATAACATAAAG

GATGATATTATGAATACGGGGAAATCTGTAAATAATATAAAACAAAAATTTTCTAGTAAT

TTGCCACTAAAAGAAAAATTATTTCAAATGGAAGAGATGTTACTTAATATAAATAATATT

ATGAATGAAACGAAAAGAATATCAAACACGGATGCATATACTAATATAACTCTCCAGGAT

ATTGAAAATAATAAAAATAAAGAAAATAATAATATGAATATTGAAACAATTGATAAATTA

ATAGATCATATAAAAATACATAATGAAAAAATACAAGCAGAAATATTAATAATTGATGAT

GCCAAAAGAAAAGTAAAGGAAATAACAGATAATATTAACAAGGCTTTTAATGAAATTACA

GAAAATTATAATAATGAAAATAATGGGGTAATTAAATCTGCAAAAAATATTGTCGATAAA

GCTACTTATTTAAATAATGAATTAGATAAATTTTTATTGAAATTGAATGAATTATTAAGT

CATAATAATAATGATATAAAGGATCTTGGTGATGAAAAATTAATATTAAAAGAAGAAGAA

GAAAGAAAAGAAAGAGAAAGATTGGAAAAAGCGAAACAAGAAGAAGAAAGAAAAGAGAGA

GAAAGAATAGAAAAAGAAAACAAGAGAAAGAAAGACTGGAAAGAGAGAAACAAGAACAA

CTAAAAAAGAAGCATTAAAAAAACAAGAGCAAGAAAGACAAGAACAACAACAAAAAGAA

GAAGCATTAAAAAGACAAGAACAAGAACGACTACAAAAAGAAGAAGAATTAAAAAGACAA

GAGCAAGAAACGCTGGAAAGAGAGAAACAAGAACAACTACAAAAAGAAGAAGAATTAAGA

AAAAAAGAGCAGGAAAAACAACAACAAAGAAATATCCAAGAATTAGAAGAGCAAAAAAAG

CCTGAAATAATAAATGAAGCATTGGTAAAGGGGGATAAAATACTAGAAGGAAGTGATCAG

AGAAATATGGAATTAAGCAAACCTAACGTTAGTATGGATAATACTAATAATAGTCCAATT

AGTAACAGTGAAATTACAGAAAGCGATGATATTGATAACAGTGAAAATATACATACTAGT

CATATGAGTGACATCGAAAGTACACAAACTAGTCATAGAAGTAACACCCATGGGCAACAA

ATCAGTGATATTGTTGAAGATCAAATTACACATCCTAGTAATATTGGAGGAGAAAAAATT

ACTCATAATGATGAAATTTCAATCACTGGTGAAAGAAATAACATTAGCGATGTTAATGAT

TATAGTGAAAGTAGCAACATATTTGAAAATGGTGACAGTACTATAAATACCAGTACAAGA

AACACGTCTAGTACACATGATGAATCCCATATAAGTCCTATCAGCAATGCGTATGATCAT

GTTGTTTCAGATAATAAAAAAAGTATGGATGAAAACATAAAAGATAAATTAAAGATAGAT

GAAAGTATAACTACAGATGAACAAATAAGGATTAGATGATAATTCTAATATTGTTAGAATT

-continued

```
GATAGTACTGACCAACGTGATGCTAGTAGTCATGGTAGTAGTAATAGGGATGATGATGAA
ATAAGTCATGTTGGTAGCGACATTCATATGGATAGTGTTGATATTCATGATAGTATTGAC
ACTGATGAAAATGCTGATCACAGACATAATGTTAACTCTGTTGATAGTCTTAGTTCTAGT
GATTACACTGATACACAGAAAGACTTTAGTAGTATTATTAAAGATGGGGGAAATAAAGAA
GGACATGCTGAGAATGAATCTAAAGAATATGAATCCCAAACAGAACAAACACATGAAGAA
GGAATTATGAATCCAAATAAATATTCAATTAGTGAAGTTGATGGTATTAAATTAAATGAA
GAAGCTAAACATAAAATTACAGAAAAACTGGTAGATATCTATCCTTCTACATATAGAACA
CTTGATGAACCTATGGAAACACATGGTCCAAATGAAAAATTTCATATGTTTGGTAGTCCA
TATGTAACAGAAGAAGATTACACGGAAAAACATGATTATGATAAGCATGAAGATTTCAAT
AATGAAAGGTATTCAAACCATAACAAAATGGATGATTTCGTATATAATGCTGGAGGAGTT
GTTTGTTGTGTATTATTTTTTGCAAGTATTACTTTCTTTTCTATGGACAGATCAAATAAG
GATGAATGCGATTTTGATATGTGTGAAGAAGTAAATAATAATGATCACTTATCGAATTAT
GCTGATAAAGAAGAAATTATTGAAATTGTGTTTGATGAAAATGAAGAAAAATATTTTTAA
```

The nucleotide sequence of Rh4 is given below (SEQ ID NO:4)

```
ATGAATAAGAATATATTGTGGATAACTTTTTTTTATTTTTTATTTTTTCTCTTGGATATG
TACCAAGGAAATGACGCAATTCCCTCAAAAGAAAAAAAAACGATCCAGAAGCAGATTCT
AAGAACTCACAGAATCAACATGATATAAATAAAACACACCATACGAACAATAATTATGAT
CTGAATATTAAGGATAAAGATGAGAAAAAAGAAAAAATGATAATTTAATCAATAATTAT
GATTACTCTCTTTTAAAGTTATCTTATAATAAGAATCAAGATATATATAAGAATATACAA
AATGGCCAAAAGCTTAAAACAGACATAATATTAAACTCATTTGTTCAAATTAATTCATCA
AACATATTAATGGATGAAATAGAAAATTATGTGAAAAAATATACGGAATCGAATCGTATT
ATGTACTTACAATTTAAATATATATATCTACAATCCTTAAATATAACAGTATCTTTTGTA
CCTCCGAATTCACCATTTCGAAGTTATTATGACAAAAATTTAAATAAAGATATAAATGAA
ACTTGTCATTCCATACAAACACTTCTAAACAATCTAATATCTTCCAAAATTATATTTAAA
ATGTTAGAAACTACAAAAGAACAAATATTACTTTTATGGAATAACAAAAAAATTAGTCAA
CAAAATTATAATCAAGAAAATCAAGAAAAAAGTAAAATGATCGATTCGGAAAATGAAAAA
CTAGAAAAGTACACAAACAAGTTTGAACATAATATCAAACCTCATATAGAAGATATAGAG
AAAAAAGTAAATGAATATATTAATAATTCCGATTGTCATTTAACATGTTCAAATATAAA
ACAATTATCAATAATTATATAGATGAAATAATAACAACTAATACAAACATATACGAAAAC
AAATATAATCTACCACAAGAACGAATTATCAAAAACTATAATCATAATGGTATTAATAAT
GATGATAATTTTATAGAATATAATATTCTTAATGCAGATCCTCATTTAAGATCTCATTTT
ATAACACTTCTTGTTTCAAGAAAACAATTAATCTATATTGAATATATTTACTTTATTAAC
AAACATATTGTAAATAAAATTCAAGAAACTTTAAATTAAATCAAAATAAATATATACAT
TTTATTAATTCAAATAATGCTGTTAATGCTGCTAAAGAATATGAATATATCATAAAATAT
TATACTACATTCAAATATCTACAGACATTAAATAAATCATTATACGACTCTATATATAAA
CATAAAATAAATAATTATTCTCATAACATTGAAGATCTTATAAACCAACTACAACATAAA
ATTAATAACCTAATGATTATCTCATTCGATAAAAATAAATCATCAGATTTAATGTTACAA
TGTACAAATATAAAAAAATATACCGATGATATATGTTTATCCATTAAACCTAAAGCATTA
```

-continued

```
GAAGTCGAATATTTAAGAAATATAAATAAACACATCAACAAAAATGAATTCCTAAATAAA

TTCATGCAAAACGAAACATTTAAAAAAAATATAGATGATAAAATCAAAGAAATGAATAAT

ATATACGATAATATATATATCATATTAAAACAAAAATTCTTAAACAAATTAAACGAAATC

ATACAAAATCATAAAAATAAACAAGAAACAAAATTAAATACCACAACCATTCAAGAATTG

TTACAACTTCTAAAGGATATTAAAGAAATACAAACAAAACAAATCGATACAAAAATTAAT

ACTTTTAATATGTATTATAACGATATACAACAAATAAAAATAAAGATTAATCAAAATGAA

AAAGAAATAAAAAAGGTACTCCCTCAATTATATATCCCAAAAAATGAACAAGAATATATA

CAAATATATAAAAATGAATTAAAGGATAGAATAAAAGAAACACAAACAAAAATTAATTTA

TTTAAGCAAATTTTAGAATTAAAAGAAAAAGAACATTATATTACAAACAAACATACATAC

CTAAATTTTACACACAAAACTATTCAACAAATATTACAACAACAATATAAAAACAACACA

CAAGAAAAAAATACACTAGCACAATTTTTATACAATGCAGATATCAAAAAATATATTGAT

GAATTAATACCTATCACACAACAAATACAAACCAAAATGTATACAACAAATAATATAGAA

CATATTAAACAAATACTCATAAATTATATACAAGAATGTAAACCTATACAAAATATATCA

GAACATACTATTTATACACTATATCAAGAAATCAAAACAAATCTGGAAAACATCGAACAG

AAAATTATGCAAAATATACAACAAACTACAAATCGGTTAAAAATAAATATTAAAAAAATA

TTTGATCAAATAAATCAAAAATATGACGACTTAACAAAAAATATAAACCAAATGAATGAT

GAAAAAATTGGGTTACGACAAATGGAAATAGGTTGAAAGGGAAATATGAAGAAATAAAA

AAGGCAAATCTTCAAGATAGGGACATAAAATATATAGTCCAAAATAATGATGCTAATAAT

AATAATAATAATATTATTATTATTAATGGTAATAATCAAACCGGTGATTATAATCACATC

TTGTTCGATTATACTCACCTTTGGGATAATGCACAATTTACTAGAACAAAAGAAAATATA

AACAACCTAAAAGATAATATACAAATCAACATAAATAATATCAAAAGTATAATAAGAAAT

TTACAAAACGAACTAAACAATTATAATACTCTTAAAAGCAATTCCATCCATATTTATGAT

AAAATACACACATTAGAAGAATTAAAAATATTAACTCAAGAAATTAATGATAAAAATGTT

ATCAGAAAAATATATGATATTGAAACCATATATCAAAATGATTTACATAACATAGAAGAA

ATTATTAAAAATATTACAAGCATTTATTACAAAATAAATATCTTAAATATATTAATTATT

TGCATCAAACAAACATATAATAATAATAAATCCATTGAAAGCTTAAAACTTAAAATTAAT

AACTTAACAAATTCAACACAAGAATATATTAATCAAATAAAAGCTATCCCAACTAATTTA

TTACCAGAACATATAAAACAAAAAAGTGTAAGCGAACTAAATATTTATATGAAACAAATA

TATGATAAATTAAATGAACATGTTATTAATAATTTATATACAAAATCAAAGGATTCATTA

CAATTTATATTAACGAAAAAAATTATAATAATAATCATGATGATCATAATGATGACCAT

AATGATGTATATAATGATATCAAAGAAAATGAAATATATAAAAATAATAAATTATACGAA

TGCATACAAATCAAAAAGGATGTAGACGAATTATATAATATTTATGATCAACTCTTTAAA

AATATATCCCAAAATTATAATAACCACTCCCTTAGTTTTGTACATTCAATAAATAATCAT

ATGCTATCTATTTTTCAAGATACTAAATATGGAAAACACAAAAATCAACAAATCCTATCC

GATATAGAAAATATTATAAAACAAAATGAACACACAGAATCATATAAAAATTTAGACACA

AGTAATATACAACTAATAAAAGAACAAATTAAATATTTCTTACAAATATTTCATATACTT

CAAGAAAATATAACCACTTTCGAAAATCAATATAAAGATTTAATTATCAAAATGAACCAT

AAAATTAATAATAATCTAAAAGATATTACACATATTGTCATAAACGATAACAATACATTA

CAAGAACAAAATCGTATTTATAACGAACTTCAAAACAAAATTAAACAAATAAAAAATGTC

AGTGATGTATTCACACATAATATTAATTACAGTCAACAAATATTAAATTATTCTCAAGCA

CAAAATAGTTTTTTTAATATATTTATGAAATTTCAAAACATTAATAATGATATTAATAGC
```

-continued

AAACGATATAATGTACAAAAAAAAATTACAGAGATAATCAATTCATATGATATAATAAAT

TATAACAAAAATAATATCAAAGATATTTATCAACAATTCAAAAATATACAACAACAATTA

AATACAACAGAAACGCAATTGAATCATATAAAACAAAATATTAATCATTTCAAATATTTT

TATGAATCTCATCAAACCATATCTATAGTAAAGAATATGCAAATGAAAAACTAAAAATT

CAAGAATTCAACAAAAAAATACAACACTTCAAGGAAGAAACACAAATTATGATAAACAAG

TTAATACAACCTAGCCACATACATTTACATAAAATGAAATTGCCTATAACTCAACAGCAA

CTTAATACAATTCTTCATAGAAATGAACAAACAAAAAATGCTACAAGAAGTTACAATATG

AATGAGGAGGAAAATGAAATGGGATATGGCATAACTAATAAAAGGAAAAATAGTGAGACA

AATGACATGATAAATACCACCATAGGAGACAAGACAAATGTCTTAAAAAATGATGATCAA

GAAAAAGGTAAAAGGGGAACTTCCAGAAATAATAATATTCATACAAATGAAAATAATATA

AATAATGAACATACAAATGAAAATAATATAAATAATGAACATACAAATGAAAGAATATA

AATAATGAACATGCAAATGAAAAGAATATATATAATGAACATACAAATGAAAATAATATA

AATTATGAACATCCAAATAATTATCAACAAAAAAATGATGAAAAATATCACTACAACAT

AAAACAATTAATACATCACAACGTACCATAGATGATTCGAATATGGATCGAAATAATAGA

TATAACACATCATCACAACAAAAAAATAATTTGCATACAAATAATAATAGTAATAGTAGA

TACAACAATAACCATGATAAACAAAATGAACATAAATATAATCAAGGAAAATCTTCAGGG

AAAGATAACGCATATTATAGAATTTTTTATGCTGGAGGAATTACAGCTGTCTTACTTTTA

TGTTCAAGTACTGCATTCTTTTTTATAAAAAACTCTAATGAACCACATCATATTTTTAAT

ATTTTTCAAAAGGAATTTAGTGAAGCAGATAATGCACATTCAGAAGAAAAGAAGAATAT

CTACCTGTCTATTTTGATGAAGTTGAAGATGAAGTTGAAGATGAAGTTGAAGATGAAGAT

GAAAATGAAAATGAAGTTGAAAATGAAAATGAAGATTTTAATGACATATGA

The nucleotide sequence of EBA175 is given below (SEQ ID NO: 6)

ATGAAATGTAATATTAGTATATATTTTTTTGCTTCCTTCTTTGTGTTATATTTTGCAAAA

GCTAGGAATGAATATGATATAAAAGAGAATGAAAAATTTTTAGACGTGTATAAAGAAAAA

TTTAATGAATTAGATAAAAAGAAATATGGAAATGTTCAAAAAACTGATAAGAAAATATTT

ACTTTTATAGAAAATAAATTAGATATTTTAAATAATTCAAAATTTAATAAAAGATGGAAG

AGTTATGGAACTCCAGATAATATAGATAAAAATATGTCTTTAATAAATAAACATAATAAT

GAAGAAATGTTTAACAACAATTATCAATCATTTTTATCGACAAGTTCATTAATAAAGCAA

AATAAATATGTTCCTATTAACGCTGTACGTGTGTCTAGGATATTAAGTTTCCTGGATTCT

AGAATTAATAATGGAAGAAATACTTCATCTAATAACGAAGTTTTAAGTAATTGTAGGGAA

AAAAGGAAAGGAATGAAATGGGATTGTAAAAAGAAAAATGATAGAAGCAACTATGTATGT

ATTCCTGATCGTAGAATCCAATTATGCATTGTTAATCTTAGCATTATTAAAACATATACA

AAAGAGACCATGAAGGATCATTTCATTGAAGCCTCTAAAAAAGAATCTCAACTTTTGCTT

AAAAAAAAATGATAACAAATATAATTCTAAATTTTGTAATGATTTGAAGAATAGTTTTTTA

GATTATGGACATCTTGCTATGGGAAATGATATGGATTTTGGAGGTTATTCAACTAAGGCA

GAAAACAAAATTCAAGAAGTTTTTAAAGGGGCTCATGGGGAAATAAGTGAACATAAAATT

AAAAATTTTAGAAAAAAATGGTGGAATGAATTTAGAGAGAAACTTTGGGAAGCTATGTTA

TCTGAGCATAAAAATAATATAAATAATTGTAAAAATATTCCCCAAGAAGAATTACAAATT

-continued

```
ACTCAATGGATAAAGAATGGCATGGAGAATTTTTGCTTGAAAGAGATAATAGATCAAAA
TTGCCAAAAAGTAAATGTAAAAATAATACATTATATGAAGCATGTGAGAAGGAATGTATT
GATCCATGTATGAAATATAGAGATTGGATTATTAGAAGTAAATTTGAATGGCATACGTTA
TCGAAAGAATATGAAACTCAAAAAGTTCCAAAGGAAAATGCGGAAAATTATTTAATCAAA
ATTTCAGAAAACAAGAATGATGCTAAAGTAAGTTTATTATTGAATAATTGTGATGCTGAA
TATTCAAAATATTGTGATTGTAAACATACTACTACTCTCGTTAAAAGCGTTTTAAATGGT
AACGACAATACAATTAAGGAAAAGCGTGAACATATTGATTTAGATGATTTTTCTAAATTT
GGATGTGATAAAAATTCCGTTGATACAAACACAAAGGTGTGGGAATGTAAAAAACCTTAT
AAATTATCCACTAAAGATGTATGTGTACCTCCGAGGAGGCAAGAATTATGTCTTGGAAAC
ATTGATAGAATATACGATAAAAACCTATTAATGATAAAAGAGCATATTCTTGCTATTGCA
ATATATGAATCAAGAATATTGAAACGAAAATATAAGAATAAAGATGATAAAGAAGTTTGT
AAAATCATAAATAAAACTTTCGCTGATATAAGAGATATTATAGGAGGTACTGATTATTGG
AATGATTTGAGCAATAGAAAATTAGTAGGAAAAATTAACACAAATTCAAATTATGTTCAC
AGGAATAAACAAATGATAAGCTTTTTCGTGATGAGTGGTGGAAAGTTATTAAAAAGAT
GTATGGAATGTGATATCATGGGTATTCAAGGATAAAACTGTTTGTAAAGAAGATGATATT
GAAAATATACCACAATTCTTCAGATGGTTTAGTGAATGGGGTGATGATTATTGCCAGGAT
AAAACAAAATGATAGAGACTCTGAAGGTTGAATGCAAAGAAAAACCTTGTGAAGATGAC
AATTGTAAACGTAAATGTAATTCATATAAAGAATGGATATCAAAAAAAAAAGAAGAGTAT
AATAAACAAGCCAAACAATACCAAGAATATCAAAAAGGAAATAATTACAAAATGTATTCT
GAATTTAAATCTATAAAACCAGAAGTTTATTTAAAGAAATACTCGGAAAAATGTTCTAAC
CTAAATTTCGAAGATGAATTTAAGGAAGAATTACATTCAGATTATAAAAATAAATGTACG
ATGTGTCCAGAAGTAAAGGATGTACCAATTTCTATAATAAGAAATAATGAACAAACTTCG
CAAGAAGCAGTTCCTGAGGAAAGCACTGAAATAGCACACAGAACGGAAACTCGTACGGAT
GAACGAAAAAATCAGGAACCAGCAAATAAGGATTTAAAGAATCCACAACAAAGTGTAGGA
GAGAACGGAACTAAAGATTTATTACAAGAAGATTTAGGAGGATCACGAAGTGAAGACGAA
GTGACACAAGAATTTGGAGTAAATCATGGAATACCTAAGGGTGAGGATCAAACGTTAGGA
AAATCTGACGCCATTCCAAACATAGGCGAACCCGAAACGGGAATTTCCACTACAGAAGAA
AGTAGACATGAAGAAGGCCACAATAAACAAGCATTGTCTACTTCAGTCGATGAGCCTGAA
TTATCTGATACACTTCAATTGCATGAAGATACTAAAGAAAATGATAAACTACCCCTAGAA
TCATCTACAATCACATCTCCTACGGAAAGTGGAAGTTCTGATACAGAGGAAACTCCATCT
ATCTCTGAAGGACCAAAAGGAAATGAACAAAAAAAACGTGATGACGATAGTTTGAGTAAA
ATAAGTGTATCACCAGAAAATTCAAGACCTGAAACTGATGCTAAAGATACTTCTAACTTG
TTAAAATTAAAAGGAGATGTTGATATTAGTATGCCTAAAGCAGTTATTGGGAGCAGTCCT
AATGATAATATAAATGTTACTCAACAAGGGGATAATATTTCCGGGGTGAATTCTAAACCT
TTATCTGATGATGTACGTCCAGATAAAAATCATGAAGAGGTGAAAGAACATACTAGTAAT
TCTGATAATGTTCAACAGTCTGGAGGAATTGTTAATATGAATGTTGAGAAAGAACTAAAA
GATACTTTAGAAAATCCTTCTAGTAGCTTGGATGAAGGAAAAGCACATGAAGAATTATCA
GAACCAAATCTAAGCAGTGACCAAGATATGTCTAATACACCTGGACCTTTGGATAACACC
AGTGAAGAAACTACAGAAAGAATTAGTAATAATGAATATAAAGTTAACGAGAGGGAAGGT
GAGAGAACGCTTACTAAGGAATATGAAGATATTGTTTTGAAAAGTCATATGAATAGAGAA
TCAGACGATGGTGAATTATATGACGAAAATTCAGACTTATCTACTGTAAATGATGAATCA
```

-continued

```
GAAGACGCTGAAGCAAAAATGAAAGGAAATGATACATCTGAAATGTCGCATAATAGTAGT

CAACATATTGAGAGTGATCAACAGAAAAACGATATGAAAACTGTTGGTGATTTGGGAACC

ACACATGTACAAAACGAAATTAGTGTTCCTGTTACAGGAGAAATTGATGAAAAATTAAGG

GAAAGTAAAGAATCAAAAATTCATAAGGCTGAAGAGGAAAGATTAAGTCATACAGATATA

CATAAAATTAATCCTGAAGATAGAAATAGTAATACATTACATTTAAAAGATATAAGAAAT

GAGGAAAACGAAAGACACTTAACTAATCAAAACATTAATATTAGTCAAGAAAGGGATTTG

CAAAAACATGGATTCCATACCATGAATAATCTACATGGAGATGGAGTTTCCGAAAGAAGT

CAAATTAATCATAGTCATCATGGAAACAGACAAGATCGGGGGGGAAATTCTGGGAATGTT

TTAAATATGAGATCTAATAATAATAATTTTAATAATATTCCAAGTAGATATAATTTATAT

GATAAAAAATTAGATTTAGATCTTTATGAAAACAGAAATGATAGTACAACAAAAGAATTA

ATAAAGAAATTAGCAGAAATAAATAAATGTGAGAACGAAATTTCTGTAAAATATTGTGAC

CATATGATTCATGAAGAAATCCCATTAAAAACATGCACTAAAGAAAAAACAAGAAATCTG

TGTTGTGCAGTATCAGATTACTGTATGAGCTATTTTACATATGATTCAGAGGAATATTAT

AATTGTACGAAAAGGGAATTTGATGATCCATCTTATACATGTTTCAGAAAGGAGGCTTTT

TCAAGTATGCCATATTATGCAGGAGCAGGTGTGTTATTTATTATATTGGTTATTTTAGGT

GCTTCACAAGCCAAATATCAAAGGTTAGAAAAAATAAATAAAAATAAAATTGAGAAGAAT

GTAAATTAA
```

The nucleotide sequence of EBA181 is given below (SEQ ID NO:8)

```
ATGAAAGGGAAAATGAATATGTGTTTGTTTTTTTCTATTCTATATTATATGTTGTATTA

TGTACCTATGTATTAGGTATAAGTGAAGAGTATTTGAAGGAAAGGCCCCAAGGTTTAAAT

GTTGAGACTAATAATAATAATAATAATAATAATAATAATAGTAATAGTAACGATGCG

ATGTCTTTTGTAAATGAAGTAATAAGGTTTATAGAAAACGAGAAGGATGATAAAGAAGAT

AAAAAGTGAAGATAATATCTAGACCTGTTGAGAATACATTACATAGATATCCAGTTAGT

TCTTTTCTGAATATCAAAAAGTATGGTAGGAAAGGGAATATTTGAATAGAAATAGTTTT

GTTCAAAGATCATATATAAGGGGTTGTAAAGGAAAAAGAAGCACACATACATGGATATGT

GAAAATAAAGGGAATAATAATATATGTATTCCTGATAGACGTGTACAATTATGTATAACA

GCTCTTCAAGATTTAAAAAATTCAGGATCTGAAACGACTGATAGAAAATTATTAAGAGAT

AAAGTATTTGATTCAGCTATGTATGAAACTGATTTGTTATGGAATAAATATGGTTTTCGT

GGATTTGATGATTTTTGTGACGATGTAAAAAATAGTTATTTAGATTATAAAGATGTTATA

TTTGGAACCGATTTAGATAAAAATAATATATCAAAGTTAGTAGAGGAATCATTAAAACGT

TTTTTTAAAAAAGATAGTAGTGTACTTAATCCTACTGCTTGGTGGAGAAGGTATGGAACA

AGACTATGCAAAACTATGATACAGCCATATGCTCATTTAGGATGTAGAAAACCTGATGAG

AATGAACCTCAGATAAATAGATGGATTCTGGAATGGGGGAAATATAATTGTAGATTAATG

AAGGAGAAAGAAAAATTGTTAACAGGAGAATGTTCTGTTAATAGAAAAAAATCTGACTGC

TCAACCGGATGTAATAATGAGTGTTATACCTATAGGAGTCTTATTAATAGACAAAGATAT

GAGGTCTCTATATTAGGAAAAAAATATATTAAAGTAGTACGATATACTATATTTAGGAGA

AAAATAGTTCAACCTGATAATGCTTTGGATTTTTAAAATTAAATTGTTCTGAGTGTAAG

GATATTGATTTTAAACCCTTTTTTGAATTTGAATATGGTAAATATGAAGAAAATGTATG
```

-continued
TGTCAATCATATATTGATTTAAAAATCCAATTTAAAAATAATGATATTTGTTCATTTAAT

GCTCAAACAGATACTGTTTCTAGCGATAAAAGATTTTGTCTTGAAAAGAAAGAATTTAAA

CCATGGAAATGTGATAAAAATTCTTTTGAAACAGTTCATCATAAAGGTGTATGTGTGTCA

CCGACAACACAAGGTTTTTGTTTAGGAAATTTGAACTATCTACTGAATGATGATATTTAT

AATGTACATAATTCACAACTACTTATCGAAATTATAATGGCTTCTAAACAAGAAGGAAAG

TTATTATGGAAAAAACATGGAACAATACTTGATAACCAGAATGCATGCAAATATATAAAT

GATAGTTATGTTGATTATAAAGATATAGTTATTGGAAATGATTTATGGAATGATAACAAC

TCTATAAAAGTTCAAATAATTTAAATTTAATTTTTGAAAGAAATTTTGGTTATAAAGTT

GGAAGAAATAAACTCTTTAAAACAATTAAAGAATTAAAAAATGTATGGTGGATATTAAAT

AGAAATAAAGTATGGGAATCAATGAGATGTGGAATTGACGAAGTAGATCAACGTAGAAAA

ACTTGTGAAAGAATAGATGAACTAGAAAACATGCCACAATTCTTTAGATGGTTTTCACAA

TGGGCACATTTCTTTTGTAAGGAAAAGAATATTGGGAATTAAAATTAAATGATAAATGT

ACAGGTAATAATGGAAAATCCTTATGTCAGGATAAACATGTCAAAATGTGTGTACTAAT

ATGAATTATTGGACATATACTAGAAAATTAGCTTATGAAATACAATCCGTAAAATATGAT

AAAGATAGAAAATTATTTAGTCTTGCTAAAGACAAAAATGTAACTACATTTTTAAAGGAA

AATGCAAAAAATTGTTCTAATATAGATTTTACAAAAATATTCGATCAGCTTGACAAACTC

TTTAAGGAAAGATGTTCATGTATGGATACACAAGTTTTAGAAGTAAAAAACAAAGAAATG

TTATCTATAGACTCAAATAGTGAAGATGCGACAGATATAAGTGAGAAAATGGAGAGGAA

GAATTATATGTAAATCACAATTCTGTGAGTGTCGCAAGTGGTAATAAAGAAATCGAAAAG

AGTAAGGATGAAAAGCAACCTGAAAAAGAAGCAAAACAAACTAATGGAACTTTAACCGTA

CGAACTGACAAAGATTCAGATAGAAACAAAGGAAAAGATACAGCTACTGATACAAAAAAT

TCACCTGAAAATTTAAAAGTACAGGAACATGGAACAAATGGAGAAACAATAAAAGAAGAA

CCACCAAAATTACCTGAATCATCTGAAACATTACAATCACAAGAACAATTAGAAGCAGAA

GCACAAAAACAAAAACAAGAAGAAGAACCAAAAAAAAAACAAGAAGAAGAACCAAAAAAA

AAACAAGAAGAAGAACAAAAACGAGAACAAGAACAAAAACAAGAACAAGAAGAAGAAGAA

CAAAAACAAGAAGAAGAACAACAAATACAAGATCAATCACAAAGTGGATTAGATCAATCC

TCAAAAGTAGGAGTAGCGAGTGAACAAAATGAAATTTCTTCAGGACAAGAACAAAACGTA

AAAAGCTCTTCACCTGAAGTAGTTCCACAAGAAACAACTAGTGAAAATGGGTCATCACAA

GACACAAAAATATCAAGTACTGAACCAAATGAGAATTCTGTTGTAGATAGAGCAACAGAT

AGTATGAATTTAGATCCTGAAAAGGTTCATAATGAAAATATGAGTGATCCAAATACAAAT

ACTGAACCAGATGCATCTTTAAAAGATGATAAGAAGGAAGTTGATGATGCCAAAAAAGAA

CTTCAATCTACTGTATCAAGAATTGAATCTAATGAACAGGACGTTCAAAGTACACCACCC

GAAGATACTCCTACTGTTGAAGGAAAAGTAGGAGATAAAGCAGAAATGTTAACTTCTCCG

CATGCGACAGATAATTCTGAGTCGGAATCAGGTTTAAATCCAACTGATGACATTAAAACA

ACTGATGGTGTTGTTAAAGAACAAGAAATATTAGGGGGAGGTGAAAGTGCAACTGAAACA

TCAAAAAGTAATTTAGAAAAACCTAAGGATGTTGAACCTTCTCATGAAATATCTGAACCT

GTTCTTTCTGGTACAACTGGTAAAGAAGAATCAGAGTTATTAAAAAGTAAATCGATAGAG

ACGAAGGGGAAACAGATCCTCGAAGTAATGACCAAGAAGATGCTACTGACGATGTTGTA

GAAAATAGTAGAGATGATAATAATAGTCTCTCTAATAGCGTAGATAATCAAAGTAATGTT

TTAAATAGAGAAGATCCTATTGCTTCTGAAACTGAAGTTGTAAGTGAACCTGAGGATTCA

AGTAGGATAATCACTACAGAAGTTCCAAGTACTACTGTAAAACCCCCTGATGAAAAACGA

-continued

```
TCTGAAGAAGTAGGAGAAAAAGAAGCTAAAGAAATTAAAGTAGAACCTGTTGTACCAAGA

GCCATTGGAGAACCAATGGAAAATTCTGTGAGCGTACAGTCCCCTCCTAATGTAGAAGAT

GTTGAAAAAGAAACATTGATATCTGAGAATAATGGATTACATAATGATACACACAGAGGA

AATATCAGTGAAAAGGATTTAATCGATATTCATTTGTTAAGAAATGAAGCGGGTAGTACA

ATATTAGATGATTCTAGAAGAAATGGAGAAATGACAGAAGGTAGCGAAAGTGATGTTGGA

GAATTACAAGAACATAATTTTAGCACACAACAAAAAGATGAAAAAGATTTTGACCAAATT

GCGAGCGATAGAGAAAAGAAGAAATTCAAAAATTACTTAATATAGGACATGAAGAGGAT

GAAGATGTATTAAAAATGGATAGAACAGAGGATAGTATGAGTGATGGAGTTAATAGTCAT

TTGTATTATAATAATCTATCAAGTGAAGAAAAATGGAACAATATAATAATAGAGATGCT

TCTAAAGATAGAGAAGAAATATTGAATAGGTCAAACACAAATACATGTTCTAATGAACAT

TCATTAAAATATTGTCAATATATGGAAAGAAATAAGGATTTATTAGAAACATGTTCTGAA

GACAAAAGGTTACATTTATGTTGTGAAATATCAGATTATTGTTTAAAATTTTTCAATCCT

AAATCGATAGAATACTTTGATTGTACACAAAAAGAATTTGATGACCCTACATATAATTGT

TTTAGAAAACAAAGATTTACAAGTATGCATTATATTGCCGGGGGTGGTATAATAGCCCTT

TTATTGTTTATTTTAGGTTCAGCCAGCTATAGGAAGAATTTGGATGATGAAAAGGATTC

TACGATTCTAATTTAAATGATTCTGCTTTTGAATATAATAATAATAAATATAATAAATTA

CCTTATATGTTTGATCAACAAATAAATGTAGTAAATTCTGATTTATATTCGGAGGGTATT

TATGATGACACAACGACATTTTAA
```

The nucleotide sequence of EBA140 is given below (SEQ ID NO:10)

```
ATGAAAGGATATTTTAATATATATTTTTTAATTCCTTTAATTTTTTATATAATGTAATA

AGAATAAATGAATCAATTATAGGTAGAACACTTTATAATAGACAAGATGAATCATCAGAT

ATTTCAAGGGTAAATTCACCCGAATTAATAATAATCATAAAACTAATATATATGATTCA

GATTACGAAGATGTAAATAATAAATTAATAAACAGTTTTGTAGAAAATAAAAGTGTGAAA

AAAAAAAGGTCTTTAACTTTTATAAATAATAAAACAAAATCATATGATATAATTCCACCT

TCATATTCATATAGGAATGATAAATTTAATTCACTTTCCGAAAATGAAGATAATTCTGGA

AATACAAATAGTAATAATTTCGCAAATACTTCTGAAATATCTATTGGAAAGGATAATAAA

CAATATACGTTTATACAGAAACGTACTCATTTGTTTGCTTGTGGAATAAAAAGAAAATCA

ATAAAATGGATATCTCGAGAAAACAGTGAGAAAATTACTGTATGTGTTCCTGATAGAAAA

ATACAACTATGTATTGCAAATTTTTTAAACTCACGTTTAGAAACAATGGAAAAGTTTAAA

GAAATATTTTTAATTTCTGTTAATACAGAAGCAAAATTATTATATAACAAAAATGAAGGA

AAAGATCCCTCAATATTTTGTAATGAATTAACAAATAGTTTTTCAGATTTTAGAAATTCA

TTTATAGGTGATGATATGGATTTTGGTGGTAATACAGATAGAGTCAAAGGATATATTAAT

AAGAAGTTCTCCGATTATTATAAGGAAAAAAATGTTGAAAAATTAAATAATATCAAAAAA

GAATGGTGGGAAAAAAATAAAGCAAATTTGTGGAATCACATGATAGTAAATCATAAAGGA

AACATAAGTAAAGAATGTGCCATAATTCCCGCGGAAGAACCTCAAATTAATCTATGGATA

AAAGAATGGAATGAAAACTTCTTGATGGAAAAGAAGAGATTGTTTTAAATATAAAAGAT

AAGTGTGTTGAAAACAAAAAATATGAAGCATGTTTTGGTGGATGTAGGCTTCCATGTTCT

TCATATACATCATTTATGAAAAAAGTAAAACACAAATGGAGGTTTTGACGAACTTGTAT
```

-continued

```
AAAAAGAAAAATTCAGGAGTGGATAAAAATAATTTTCTGAATGATCTTTTTAAAAAAAAT

AATAAAAATGATTTAGATGATTTTTTCAAAAATGAAAAGGAATATGATGATTTATGTGAT

TGCAGATATACTGCTACTATTATTAAAAGTTTTCTAAATGGTCCTGCTAAAAATGATGTA

GATATTGCATCACAAATTAATGTTAATGATCTTCGAGGGTTTGGATGTAATTATAAAAGT

AATAATGAAAAAGTTGGAATTGTACTGGAACATTTACGAACAAATTTCCTGGTACATGT

GAACCCCCAGAAGACAAACTTTATGTCTTGGACGTACATATCTTTTACATCGTGGTCAT

GAGGAAGATTATAAGGAACATTTACTTGGAGCTTCAATATATGAGGCGCAATTATTAAA

TATAAATATAAGGAAAAGGATGAAAATGCATTGTGTAGTATAATACAAAATAGTTATGCA

GATTTGGCAGATATTATCAAGGGATCGGATATAATAAAAGATTATTATGGTAAAAAATG

GAAGAAAATTTAAATAAAGTAAACAAAGATAAAAAACGTAATGAAGAATCTTTGAAGATT

TTTCGTGAAAAATGGTGGGATGAAAACAAGGAGAATGTATGGAAAGTAATGTCAGCAGTA

CTTAAAAATAAGGAAACGTGTAAAGATTATGATAAGTTTCAAAAGATTCCTCAATTTTTA

AGATGGTTTAAGGAATGGGGAGACGATTTTTGTGAGAAAAGAAAAGAGAAAATATATTCA

TTTGAGTCATTTAAGGTAGAATGTAAGAAAAAAGATTGTGATGAAAATACATGTAAAAAT

AAATGTAGTGAATATAAAAAATGGATAGATTTGAAAAAAAGTGAATATGAGAAACAAGTT

GATAAATACACAAAAGATAAAAATAAAAAGATGTATGATAATATTGATGAAGTAAAAAAT

AAAGAAGCCAATGTTTACTTAAAAGAAAAATCCAAAGAATGTAAAGATGTAAATTTCGAT

GATAAAATTTTTAATGAGAGTCCAAATGAATATGAAGATATGTGTAAAAAATGTGATGAA

ATAAAATATTTAAATGAAATTAAATATCCTAAAACAAAACACGTATATATGATATAGAT

ACATTTTCAGATACTTTTGGTGATGGAACGCCAATAAGTATTAATGCAAATATAAATGAA

CAACAAAGTGGGAAGGATACCTCAAATACTGGAAATAGTGAAACATCAGATTCACCGGTT

AGTCATGAACCAGAAAGTGATGCTGCAATTAATGTAGAAAAGTTAAGTGGTGATGAAAGT

TCAAGTGAAACAAGAGGAATATTAGATATTAATGATCGAAGTGTTACGAACAATGTCAAT

GAAGTTCATGATGCTTCAAATACACAAGGTAGTGTTTCAAATACTTCTGATATAACGAAT

GGACATTCGGAAAGTTCCCTGAATAGAACAACGAATGCACAAGATATTAAAATAGGCCGT

TCAGGAAATGAACAAAGTGATAATCAAGAAAATAGTTCACATTCTAGTGATAATTCAGGT

TCTTTGACAATCGGACAAGTTCCTTCAGAGGATAATACCCAAAATACATATGATTCACAA

AACCCTCATAGAGATACACCTAATGCATTAGCATCTTTACCATCAGATGATAAAATTAAT

GAAATAGAGGGTTTCGATTCTAGTAGAGATAGTGAAAATGGTAGGGGTGATACAACATCA

AATACTCATGATGTACGTCGTACGAATATAGTAAGTGAGAGACGTGTGAATAGCCATGAT

TTTATTAGAAACGGAATGGCGAATAACAATGCACATCATCAATATATAACGCAAATTGAG

AATAATGGAATCATAAGAGGACAAGAGGAAAGTGCGGGGAATAGTGTTAATTATAAAGAT

AATCCAAAGAGGAGTAATTTTTCCTCCGAAAATGATCATAAGAAAAATATACAGGAATAT

AATTCTAGAGATACTAAAAGAGTAAGGGAGGAAATAATTAAATTATCGAAGCAAAATAAA

TGCAACAATGAATATTCCATGGAATATTGTACCTATTCTGACGAAAGGAATAGTTCACCG

GGTCCTTGTTCTAGAGAAGAAAGAAAGAAATTATGTTGTCAGATTTCAGATTATTGTTTA

AAATATTTTAACTTTTATTCAATTGAATATTATAATTGTATAAAATCTGAAATTAAAGT

CCAGAATATAAATGTTTTAAAAGCGAGGGTCAATCAAGCATTCCTTATTTTGCTGCTGGA

GGTATTTTAGTTGTAATAGTCTTACTTTTGAGTTCAGCATCTAGAATGGGCAAAAGTAAT

GAAGAATATGATATAGGAGAATCTAATATAGAAGCAACTTTTGAAGAAAATAATTATTTA
```

-continued

```
AATAAACTATCGCGCATATTTAATCAAGAAGTACAAGAGACAAACATTTCAGATTATTCC

GAGTACAATTATAATGAAAAGAATATGTATTAA
```

The nucleotide sequence of Rh2a is given below (SEQ ID NO:12)

```
ATGAAGACCACACTATTTTGTAGCATATCTTTTTGTAATATTATATTTTTCTTCTTAGAA

TTAAGTCATGAGCATTTTGTTGGACAATCAAGTAATACCCATGGAGCATCTTCAGTTACT

GATTTTAATTTTAGTGAGGAGAAAAATTTAAAAAGTTTTGAAGGGAAGAATAATAATAAT

GATAATTATGCTTCAATTAATCGTTTATATAGGAAGAAACCATATATGAAGAGATCGCTT

ATAAATTTAGAAAATGATCTTTTTAGATTAGAACCTATATCTTATATTCAAAGATATTAT

AAGAAGAATATAAACAGATCTGATATTTTTCATAATAAAAAGAAAGAGGTTCCAAAGTA

TATTCAAATGTGTCTTCATTCCATTCTTTTATTCAAGAGGGTAAAGAAGAAGTTGAGGTT

TTTTCTATATGGGGTAGTAATAGCGTTTTAGATCATATAGATGTTCTTAGGGATAATGGA

ACTGTCGTTTTTTCTGTTCAACCATATTACCTTGATATATATACGTGTAAAGAAGCCATA

TTATTTACTACATCATTTTACAAGGATCTTGATAAAAGTTCAATTACAAAAATTAATGAA

GATATTGAAAAATTTAACGAAGAAATAATCAAGAATGAAGAACAATGTTTAGTTGGTGGG

AAAACAGATTTTGATAATTTACTTATAGTTTTAGAAAATGCGGAAAAAGCAAATGTTAGA

AAAACATTATTTGATAATACATTTAATGATTATAAAAATAAGAAATCTAGTTTTTACAAT

TGTTTGAAAAATAAAAAAAATGATTATGATAAGAAAATAAAGAATATAAAGAATGAGATT

ACAAAATTGTTAAAAAATATTGAAAGTACAGGAAATATGTGTAAAACGGAATCATATGTT

ATGAATAATAATTTATATCTATTAAGAGTGAATGAAGTTAAAAGTACACCTATTGATTTA

TACTTAAATCGAGCAAAAGAGCTATTAGAATCAAGTAGCAAATTAGTTAATCCTATAAAA

ATGAAATTAGGTGATAATAAGAACATGTACTCTATTGGATATATACATGACGAAATTAAA

GATATTATAAAAGATATAATTTTCATTTGAAACATATAGAAAAAGGAAAAGAATATATA

AAAAGGATAACACAAGCAAATAATATTGCAGACAAAATGAAGAAAGATGAACTTATAAAA

AAAATTTTTGAATCCTCAAAACATTTTGCTAGTTTTAAATATAGCAATGAAATGATAAGC

AAATTAGATTCGTTATTTATAAAAAATGAAGAAATACTTAATAATTTATTCAATAATATA

TTTAATATATTCAAGAAAAAATATGAAACATATGTAGATATGAAAACAATTGAATCTAAA

TATACAACAGTAATGACTCTATCAGAACATTTATTAGAATATGCAATGGATGTTTTAAAA

GCTAACCCTCAAAAACCTATTGATCCAAAAGCAAATCTGGATTCACAAGTAGTAAAATTA

CAAATAAAAATAAATGAGAAATCAAATGAATTAGATAATGCTATAAGTCAAGTAAAAACA

CTAATAATAATAATGAAATCATTTTATGATATTATTATATCTGAAAAAGCCTCTATGGAT

GAAATGGAAAAAAAGGAATTATCCTTAAATAATTATATTGAAAAAACAGATTATATATTA

CAAACGTATAATATTTTTAAGTCTAAAAGTAATATTATAAATAATAATAGTAAAAATATT

AGTTCTAAATATATAACTATAGAAGGGTTAAAAAATGATATTGATGAATTAAATAGTCTT

ATATCATATTTTAAGGATTCACAAGAAACATTAATAAAAGATGATGAATTAAAAAAAAAC

ATGAAAACGGATTATCTTAATAACGTGAAATATATAGAAGAAATGTTACTCATATAAAT

GAAATTATATTATTAAAAGATTCTATAACTCAACGAATAGCAGATATTGATGAATTAAAT

AGTTTAAATTTAATAAATATAAATGATTTTATAAATGAAAAGAATATATCACAAGAGAAA

GTATCATATAATCTTAATAAATTATATAAAGGAAGTTTTGAAGAATTAGAATCTGAACTA
```

-continued

```
TCTCATTTTTTAGACACAAAATATTTGTTTCATGAAAAAAAAGTGTAAATGAACTTCAA

ACAATTTTAAATACATCAAATAATGAATGTGCTAAATTAAATTTTATGAAATCTGATAAT

AATAATAATAATAATAATAGTAATATAATTAACTTGTTAAAAACTGAATTAAGTCATCTA

TTAAGTCTTAAAGAAAATATAATAAAAAAACTTTTAAATCATATAGAACAAAATATTCAA

AACTCATCAAATAAGTATACTATTACATATACTGATATTAATAATAGAATGGAAGATTAT

AAAGAAGAAATCGAAAGTTTAGAAGTATATAAACATACCATTGGAAATATACAAAAAGAA

TATATATTACATTTATATGAGAATGATAAAAATGCTTTAGCTGTACATAATACATCAATG

CAAATATTACAATATAAAGATGCTATACAAAATATAAAAAATAAAATTTCTGATGATATA

AAAATTTTAAAGAAATATAAAGAAATGAATCAAGATTTATTAAATTATTATGAAATTCTA

GATAAAAAATTAAAAGATAATACATATATCAAAGAAATGCATACTGCTTCTTTAGTTCAA

ATAACTCAATATATTCCTTATGAAGATAAAACAATAAGTGAACTTGAGCAAGAATTTAAT

AATAATAATCAAAAACTTGATAATATATTACAAGATATCAATGCAATGAATTTAAATATA

AATATTCTCCAAACCTTAAATATTGGTATAAATGCATGTAATACAAATAATAAAAATGTA

GAACACTTACTTAACAAGAAAATTGAATTAAAAAATATATTAAATGATCAAATGAAAATT

ATAAAAAATGATGATATAATTCAAGATAATGAAAAAGAAAACTTTTCAAATGTTTTAAAA

AAAGAAGAGGAAAAATTAGAAAAAGAATTAGATGATATCAAATTTAATAATTTGAAAATG

GACATTCATAAATTGTTGAATTCGTATGACCATACAAAGCAAAATATAGAAAGCAATCTT

AAAATAAATTTAGATTCTTTCGAAAAGGAAAAAGATAGTTGGGTTCATTTTAAAAGTACT

ATAGATAGTTTATATGTGGAATATAACATATGTAATCAAAAGACTCATAATACTATCAAA

CAACAAAAAAATGATATCATAGAACTTATTTATAAACGTATAAAAGATATAAATCAAGAA

ATAATCGAAAAGGTAGATAATTATTATTCCCTGTCAGATAAAGCCTTAACTAAACTTAAA

TCTATTCATTTTAATATTGATAAGGAAAAATATAAAAATCCCAAAAGTCAAGAAAATATT

AAATTATTAGAAGATAGAGTTATGATACTTGAGAAAAAGATTAAGGAAGATAAAGATGCT

TTAATACAAATTAAGAATTTATCACATGATCATTTTGTAAATGCTGATAATGAGAAAAAA

AAGCAGAAGGAGAAGGAGGAGGACGACGAACAAACACACTATAGTAAAAAAAGAAAAGTA

ATGGGAGATATATATAAGGATATTAAAAAAAACCTAGATGAGTTAAATAATAAAAATTTG

ATAGATATTACTTTAAATGAAGCAAATAAAATAGAATCAGAATATGAAAAAATATTAATT

GATGATATTTGTGAACAAATTACAAATGAAGCAAAAAAAGTGATACTATTAAGGAAAAA

ATCGAATCATATAAAAAAGATATTGATTATGTAGATGTGGACGTTTCCAAAACGAGGAAC

GATCATCATTTGAATGGAGATAAAATACATGATTCTTTTTTTATGAAGATACATTAAAT

TATAAAGCATATTTTGATAAATTAAAAGATTTATATGAAAATATAAACAAGTTAACAAAT

GAATCAAATGGATTAAAAAGTGATGCTCATAATAACAACACACAAGTTGATAAACTAAAA

GAAATTAATTTACAAGTATTCAGCAATTTAGGAAATATAATTAAATATGTTGAAAAACTT

GAGAATACATTACATGAACTTAAAGATATGTACGAATTTCTAGAAACGATCGATATTAAT

AAAATATTAAAAAGTATTCATAATAGCATGAAGAAATCAGAAGAATATAGTAATGAAACG

AAAAAAATATTTGAACAATCAGTAAATATAACTAATCAATTTATAGAAGATGTTGAAATA

TTGAAAACGTCTATTAACCCAAACTATGAAAGCTTAAATGATGATCAAATTGATGATAAT

ATAAAATCACTTGTTCTAAAGAAAGAGGAAATATCCGAAAAAAGAAAACAAGTGAATAAA

TACATAACAGATATTGAATCTAATAAAGAACAATCAGATTTACATTTACGATATGCATCT

AGAAGTATATATGTTATTGATCTTTTTATAAAACATGAAATAATAAATCCTAGCGATGGA

AAAAATTTTGATATTATAAAGGTTAAAGAAATGATAAATAAAACCAAACAAGTTTCAAAT
```

-continued

```
GAAGCTATGGAATATGCTAATAAAATGGATGAAAAAATAAGGACATTATAAAAATAGAA

AATGAACTTTATAATTTAATTAATAATAACATCCGTTCATTAAAAGGGGTAAAATATGAA

AAAGTTAGGAAACAAGCAAGAAATGCAATTGATGATATAAATAATATACATTCTAATATT

AAAACGATTTTAACCAAATCTAAAGAACGATTAGATGAGATTAAGAAACAACCTAACATT

AAAAGAGAAGGTGATGTTTTAAATAATGATAAAACCAAAATAGCTTATATTACAATACAA

ATAAATAACGGAAGAATAGAATCTAATTTATTAAATATATTAAATATGAAACATAACATA

GATACTATCTTGAATAAAGCTATGGATTATATGAATGATGTATCAAAATCTGACCAGATT

GTTATTAATATAGATTCTTTGAATATGAACGATATATATAATAAGGATAAAGATCTTTTA

ATAAATATTTTAAAAGAAAAACAGAATATGGAGGCAGAATATAAAAAAATGAATGAAATG

TATAATTACGTTAATGAAACAGAAAAAGAAATAATAAAACATAAAAAAAATTATGAAATA

AGAATTATGGAACATATAAAAAAGAAACAAATGAAAAAAAAAAAAATTTATGGAATCT

AATAACAAATCATTAACTACTTTAATGGATTCATTCAGATCTATGTTTTATAATGAATAT

ATAAATGATTATAATATAAATGAAAATTTTGAAAAACATCAAAATATATTGAATGAAATA

TATAATGGATTTAATGAATCATATAATATTATTAATACAAAAATGACTGAAATTATAAAT

GATAATTTAGATTATAATGAAATAAAAGAAATTAAAGAAGTAGCACAAACAGAATATGAT

AAACTTAATAAAAAGTTGATGAATTAAAAAATTATTTGAATAATATTAAAGAACAAGAA

GGACATCGATTAATTGATTATATAAAAGAAAAAATATTTAACTTATATATAAAATGTTCA

GAACAACAAAATATAATAGATGATTCTTATAATTATATTACAGTTAAAAAACAGTATATT

AAAACTATTGAAGATGTGAAATTTTTATTAGATTCATTGAACACAATAGAAGAAAAAAAT

AAATCAGTAGCAAATCTAGAAATTTGTACTAATAAAGAAGATATAAAAAATTTACTTAAA

CATGTTATAAAGTTGGCAAATTTTTCAGGTATTATTGTAATGTCTGATACAAATACGGAA

ATAACTCCAGAAAATCCTTTAGAAGATAATGATTTATTAAATTTACAATTATATTTTGAA

AGAAAACATGAAATAACATCAACATTGCAAATGATTCTGATTTAGAGTTAGATCATTTA

GGTAGTAATTCGGATGAATCTATAGATAATTTAAAGGTTTATAATGATATTATAGAATTA

CACACATATTCAACACAAATTCTTAAATATTTAGATAATATTCAAAAACTTAAAGGAGAT

TGCAATGATTTAGTAAAGGATTGTAAAGAATTACGTGAATTGTCTACGGCATTATATGAT

TTAAAAATACAAATTACTAGTGTAATTAATAGAGAAAATGATATTTCAAATAATATTGAT

ATTGTATCTAATAAATTAAATGAAATAGATGCTATACAATATAATTTTGAAAAATATAAA

GAAATTTTTGATAATGTAGAAGAATATAAAACATTAGATGATACAAAAAATGCATATATT

GTAAAAAAGGCTGAAATTTTAAAAAATGTAGATATAAATAAAACAAAAGAAGATTTAGAT

ATATATTTTAATGACTTAGACGAATTAGAAAAATCTCTTACATTATCATCTAATGAAATG

GAAATTAAAACAATAGTACAGAACTCATATAATTCCTTTTCTGATATTAATAAGAACATT

AATGATATTGATAAAGAAATGAAAACACTGATCCCTATGCTTGATGAATTATTAAATGAA

GGACATAATATTGATATATCATTATATAATTTTATAATTAGAAATATTCAGATTAAAATA

GGTAATGATATAAAAAATATAAGAGAACAGGAAAATGATACTAATATATGTTTTGAGTAT

ATTCAAAATAATTATAATTTTATAAAGAGTGATATAAGTATCTTCAATAAATATGATGAT

CATATAAAAGTAGATAATTATATATCTAATAATATTGATGTTGTCAATAAACATAATAGT

TTATTAAGTGAACATGTTATAAATGCTACAAATATTATAGAGAATATTATGACAAGTATT

GTCGAAATAAATGAAGATACAGAAATGAATTCTTTAGAAGAGACACAAGACAAATTATTA

GAACTATATGAAAATTTTAAGAAAGAAAAAAATATTTATAAATAATAATTATAAAATAGTA
```

-continued

```
CATTTTAATAAATTAAAAGAAATAGAAAATAGTTTAGAGACATATAATTCAATATCAACA

AACTTTAATAAAATAAATGAAACACAAAATATAGATATTTTAAAAAATGAATTTAATAAT

ATCAAAACAAAAATTAATGATAAAGTAAAAGAATTAGTTCATGTTGATAGTACATTAACA

CTTGAATCAATTCAAACGTTTAATAATTTATATGGTGACTTGATGTCTAATATACAAGAT

GTATATAAATATGAAGATATTAATAATGTTGAATTGAAAAAGGTGAAATTATATATAGAA

AATATTACAAATTTATTAGGAAGAATAAACACATTCATAAAGGAGTTAGACAAATATCAG

GATGAAAATAATGGTATAGATAAGTATATAGAAATCAATAAGGAAAATAATAGTTATATA

ATAAAATTGAAAGAAAAACCCAATAATCTAAAGGAAAATTTCTCAAAATTATTACAAAAT

ATAAAAAGAAATGAAACTGAATTATATAATATAAATAACATAAAGGATGATATTATGAAT

ACGGGGAAATCTGTAAATAATATAAAACAAAAATTTTCTAGTAATTTGCCACTAAAAGAA

AAATTATTTCAAATGGAAGAGATGTTACTTAATATAATAATATTATGAATGAAAACGAAA

AGAATATCAAACACGGCTGCATATACTAATATAACTCTCCAGGATATTGAAAATAATAAA

AATAAAGAAAATAATAATATGAATATTGAAACAATTGATAAATTAATAGATCATATAAAA

ATACATAATGAAAAAATACAAGCAGAAATATTAATAATTGATGATGCCAAAAGAAAAGTA

AAGGAAATAACAGATAATATTAACAAGGCTTTTAATGAAATTACAGAAAATTATAATAAT

GAAAATAATGGGGTAATTAAATCTGCAAAAAATATTGTCGATGAAGCTACTTATTTAAAT

AATGAATTAGATAAATTTTTATTGAAATTGAATGAATTATTAAGTCATAATAATAATGAT

ATAAAGGATCTTGGTGATGAAAAATTAATATTAAAAGAAGAAGAAGAAAGAAAAGAAAGA

GAAAGATTGGAAAAAGCGAAACAAGAAGAAGAAAGAAAAGAGAGAGAAAGAATAGAAAAA

GAAAAACAAGAGAAAGAAAGACTGGAAAGAGAGAAACAAGAACAACTAAAAAAAGAAGAA

GAATTAAGAAAAAAAGAGCAGGAAAGACAAGAACAACAACAAAAAGAAGAAGCATTAAAA

AGACAAGAACAAGAACGACTACAAAAAGAAGAAGAATTAAAAAGACAAGAGCAAGAAAGG

CTGGAAAGAGAGAAACAAGAACAACTACAAAAAGAAGAAGAATTAAAAAGACAAGAACAA

GAACGACTACAAAAAGAAGAAGCATTAAAAAGACAAGAACAAGAACGACTACAAAAAGAA

GAAGAATTAAAAAGACAAGAGCAAGAAAGGCTGGAAAGAGAGAAACAAGAACAACTACAA

AAAGAAGAAGAATTAAAAAGACAAGAACAAGAACGACTACAAAAAGAAGAAGCATTAAAA

AGACAAGAACAAGAACGACTACAAAAAGAAGAAGAATTAAAAAGACAAGAGCAAGAAAGA

CTGGAAAGAAAGAAAATCGAGTTAGCAGAAAGAGAACAACACATAAAAAGTAAACTAGAA

TCTGATATGGTGAAAATAATAAAGGATGAACTAACAAAAGAAAAAGATGAAATAATAAAA

AACAAAGATATAAAACTTAGACATAGTTTGGAACAGAAATGGTTAAAACATTTACAAAAT

ATATTATCGTTAAAAATAGATAGTCTATTAAATAAAAATGATGAGGTCATAAAAGATAAT

GAGACACAATTGAAAACAAATATATTGAACTCATTAAAAAATCAATTATATCTTAATTTG

AAACGTGAACTTAATGAAATTATAAAGGAATACGAAGAAAACCAGAAAAAAATATTGCAT

TCAAATCAACTTGTTAACGATAGTTTAGAGCAAAAAACTAATAGACTCGTCGATATTAAA

CCTACAAAGCATGGTGATATATATACTAATAAACTTTCTGATAATGAAACTGAAATGCTG

ATAACATCTAAAGAAAAAAAGATGAAACAGAATCAACTAAAAGATCAGGAACAGATCAT

ACTAATAGTTCGGAAAGTACTACTGATGATAATACCAATGATAGAAATTTTTCTCGATCA

AAGAATTTGAGTGTTGCTATATACACAGCAGGAAGTGTAGCTTTATGTGTGTTAATATTT

TCTAGTATAGGATTATTACTTATAAAGACTAATAGTGGAGATAACAATTCTAATGAAATT

AATGAAGCTTTTGAACCGAATGATGATGTTCTCTTTAAGGAGAAGGATGAAATCATTGAA

ATCACTTTTAATGATAATGATAGTACAATTTAA
```

The nucleotide sequence of Rh1 is given below (SEQ ID NO:14)

```
ATGCAAAGGTGGATTTTCTGCAACATTGTTTTGCATATATTAATTTACTTAGCAGAATTT
AGCCATGAACAGGAAAGTTATTCTTCCAATGAAAAAATAAGAAAGGACTATTCAGATGAT
AATAATTATGAACCTACCCCTTCATATGAAAAAACAAAAAAAGAATATGGAAAAGATGAA
AGTTATATAAAAAATTACAGAGGTAATAATTTTTCCTATGATTTGTCTAAAAATTCTAGT
ATATTTCTTCACATGGGTAACGGTAGTAACTCGAAAACACTAAAAAGATGTAACAAGAAA
AAAAATATAAAGACCAATTTTTTAAGACCTATCGAGGAAGAGAAAACGGTATTAAATAAT
TATGTATATAAAGGTGTAAATTTTTAGATACAATAAAAAGAAATGATTCCTCTTATAAA
TTTGATGTTTATAAAGATACTTCCTTTTTAAAAAATAGAGAATATAAAGAATTAATTACT
ATGCAGTATGATTATGCTTATTTAGAAGCAACAAAAGAGGTTCTTTATTTAATTCCGAAG
GATAAAGATTATCACAAATTTTATAAAAATGAACTTGAGAAAATTCTTTTCAATTTAAAA
GATTCACTTAAATTATTAAGAGAAGGATATATACAAAGCAAACTGGAAATGATTAGAATC
CATTCGGATATAGATATATTAAATGAGTTTCATCAAGGAAATATTATAAACGATAATTAT
TTTAATAATGAAATAAAAAAAAAAAAGGAAGACATGGAAAAATATATAAGAGAATATAAT
TTATACATATATAAATATGAAATCAGCTTAAAATAAAAATACAGAAATTAACAAATGAA
GTTTCTATAAATTTAAATAAATCTACATGTGAAAAGAATTGTTATAATTATATTTTAAA
TTAGAAAAATATAAAAATATAATAAAAGATAAGATAAATAAATGGAAAGATTTACCAGAA
ATATATATTGATGATAAAAGTTTCTCATATACATTTTTAAAAGATGTAATAAATAATAAG
ATAGATATATAAAACAATAAGTTCTTTTATATCTACTCAGAAACAATTATATTATTTT
GAATATATATATAATGAATAAAAATACATTAAACCTACTTTCATATAATATACAAAAA
ACAGATATAAATTCTAGTAGTAAATACACATATACAAATCTCATTTTTTAAAAGATAAT
CATATATTGTTATCTAAATATTATACTGCCAAATTTATTGATATCCTAAATAAAACATAT
TATTATAATTTATATAAAAATAAAATTCTTTTATTCAATAAATATATTATAAAGCTTAGA
AACGATTTAAAAGAATATGCATTTAAATCTATACAATTTATTCAAGATAAAATCAAAAAA
CATAAAGATGAATTATCCATAGAAAATATATTACAAGAAGTTAATAATATATATATAAAA
TATGATACTTCGATAAATGAAATATCTAAATATAACAATTTAATTATTAATACTGATTTA
CAAATAGTACAACAAAAACTTTTAGAAATCAAACAAAAAAAAAATGATATTACACACAAA
GTACAACTTATAAATCATATATATAAAAATATACATGATGAAATATTAAACAAAAAAAAT
AATGAAATAACAAAGATTATTATAAATAATATAAAAGATCATAAAAAAGATTTACAAGAT
CTCTTACTATTTATACAACAAATCAAACAATATAATATATTAACAGATCATAAAATTACA
CAATGTAATAATTATTATAAGGAAATCATAAAAATGAAAGAAGATATAAATCATATTCAT
ATATATATACAACCAATTCTAAATAATTTACACACATTAAAACAAGTACAAAATAATAAA
ATCAAATATGAAGAGCACATCAAACAAAPATTACAAAAAATTTATGATAAAAAGGAATCT
TTAAAAAAAATTATTCTCTTAAAAGATGAAGCACAATTAGACATTACCCTCCTCGATGAC
TTAATACAAAAGCAAACAAAAAAACAAACACAAACACAAACACAAAACAAACA
CTAATACAAAATAATGAGACGATTCAACTTATTTCTGGACAAGAAGATAAACATGAATCC
AATCCATTTAATCATATACAAACCTATATTCAACAAAAAGATACACAAAATAAAAACATC
CAAAATCTTCTTAAATCCTTGTATAATGGAAATATTAACACATTCATAGACACAATTTCT
AAATATATATTAAAACAAAAAGATATAGAATTAACACAACACGTTTATACAGACGAAAAA
ATTAATGATTATCTTGAAGAAATAAAAAATGAACAAAACAAAATAGATAAGACCATCGAC
```

-continued
```
GATATAAAAATACAAGAAACATTAAAACAAATAACTCATATTGTTAACAATATAAAACC

ATCAAAAAGGATTTGCTCAAAGAATTTATTCAACATTTAATAAAATATATGAACGAAAGA

TATCAGAATATGCAACAGGGTTATAATAATTTAACAAATTATATTAATCAATATGAAGAA

GAAAATAATAATATGAAACAATATATTACTACCATACGAAATATCCAAAAAATATATTAT

GATAATATATATGCTAAGCAAAAGGAAATTCGCTCGGGACAATATTATAAGGATTTTATC

ACATCAAGGAAAATATTTATAATATAAGGGAAAATATATCCAAAAATGTAGATATGATA

AAAAATGAAGAAAGAAGAAAATACAGAATTGTGTAGATAAATATAATTCTATAAAACAA

TATGTAAAAATGCTTAAAAATGGAGACACACAAGATGAAAATAATAATAATAATAATGAT

ATATACGACAAGTTAATTGTCCCCCTTGATTCAATAAAACAAAATATCGATAAATACAAC

ACAGAACATAATTTTATAACATTTACAAATAAAATAAATACACATAATAAGAAGAACCAA

GAAATGATGGAAGAATTCATATATGCATATAAAAGGTTAAAAATTTTAAAAATATTAAAT

ATATCCTTAAAAGCTTGTGAAAAAAATAATAAATCTATCAATACATTAAATGACAAAACA

CAAGAATTAAAAAAAATTGTAACACACGAAATAGATCTTCTACAAAAAGATATTTTAACA

AGTCAAATATCAAATAAAAATGTTTTATTATTAAACGATTTATTAAAAGAAATTGAACAA

TATATTATAGATGTACACAAATTAAAAAAAAAATCAAACGATCTATTTACATATTATGAA

CAATCCAAAAATTATTTCTATTTTAAAAACAAAAAAGATAATTTTGATATACAAAAAACA

ATCAATAAAATGAATGAATGGCTAGCTATCAAAAATTATATAAATGAATTAATAAAAAT

TATCAAACATTATATGAAAAAAAAATAAATGTACTCCTACATAATTCAAAAAGTTATGTA

CAATACTTTTATGATCATATAATAAATCTAATTCTTCAAAAAAAAAATTATTTGGAAAAT

ACTTTAAAGACAAAAATACAAGATAACGAACATTCACTATATCCTTTACAACAAAATGAA

GAATACCAAAAGGTAAAGAACGAAAAGGATCAAAACGAAATTAAGAAAATTAAACAATTA

ATCGAAAAAAATAAAAATGATATACTTACATATGAAAACAACATTGAACAAATTGAACAA

AAAAATATTGAGTTAAAAACAAATGCTCAAAATAAGGATGATCAAATAGTAAATACCTTA

AATGAGGTTAAGAAAAAAATAATATATACATATGAAAAGGTAGATAATCAAATATCGAAC

GTTTTAAAAAATTATGAAGAACCAAAAGTAGAATATGATAAAAATGTTGTACAAAATGTT

AACGATGCGGATGATACAAACGATATTGATGAAATAAACGATATTGATGAAATAAACGAT

ATTGATGAAATAAACGATATTGATGAAATAAACGATATTGATGAAATAAAAGACATTGAC

CATATAAAACATTTTGACGATACAAAACATTTTGACGATATATACCATCCTGATGATACA

CGTGATGAATACCATATAGCCCTTTCAAATTATATAAAGACAGAACTAAGAAATATAAAC

CTGCAAGAAATAAAAAACAATATAATAAAAATATTTAAAGAATTCAAATCTGCACACAAA

GAAATTAAAAAAGAATCAGAACAAATTAATAAAGAATTTACCAAAATGGATGTCGTCATA

AATCAATTAAGAGATATAGACAGACAAATGCTTGATCTTTATAAAGAATTAGATGAAAAA

TATTCTGAATTTAATAAAACAAAAATTGAAGAAATAAATAATATAAGGGAAAATATTAAT

AATGTGGAAATATGGTATGAAAAAAATATAATTGAATATTTCTTACGTCATATGAATGAT

CAAAAAGATAAAGCTGCAAAATATATGGAAAACATTGATACATATAAAAATAATATTGAA

ATTATTAGTAAACAAATAAATCCAGAAAATTATGTTGAAACATTAAACAAATCAAATATG

TATTCTTATGTAGAAAAGGCTAATGATCTATTTTATAAACAAATAAATAATATAATCATA

AATTCAAATCAACTAAAAAACGAAGCTTTTACAATAGATGAATTACAAAATATTCAAAAA

AACAGAAAAAATCTTCTTACAAAGAAACAACAAATTATTCAGTATACAAATGAAATAGAA

AATATATTTAATGAAATTAAAAATATTAATAACATATTAGTCTTAACAAATTATAAATCT

ATCCTTCAAGATATATCACAAAATATAAATCATGTTAGTATATATACGGAACAATTACAT
```

-continued

```
AATTTATATATAAAATTAGAAGAAGAAAAAGAACAAATGAAAACACTCTATCATAAATCA

AATGTGTTACATAACCAAATTAATTTTAATGAAGATGCTTTTATTAATAATTTATTAATT

AATATAGAAAAAATTATAAAAAGATATTACACATATAAGGAAAAAACAAATATATATATG

ATAGATGTAAACAAATCTAAAAATAATGCTCAACTATATTTTCATAATACACTAAGAGGT

AATGAAAAAATAGAATATTTAAAAAATCTTAAGAATTCAACAAACCAACAAATAACTTTA

CAAGAATTAAAACAAGTACAAGAAAATGTTGAGAAGGTAAAAGATATATACAATCAAACT

ATAAAATATGAAGAAGAAATTAAAAAAAATTATCATATTATAACAGATTATGAGAATAAA

ATAAATGATATTTTACATAATTCATTTATTAAACAAATAAATATGGAATCTAGCAATAAT

AAAAAACAAACAAAACAAATTATAGACATAATAAACGATAAAACATTTGAAGAACATATA

AAAACATCCAAAACCAAATAAACATGCTAAAAGAACAATCACAAATGAAACATATAGAC

AAAACTTTATTAAATGAACAAGCACTCAAATTATTTGTAGATATTAATTCTACTAATAAT

AATTTAGATAATATGTTATCTGAAATAAATTCTATACAAAATAATATACATACATATATC

CAAGAAGCAAACAAATCATTTGACAAATTTAAAATTATATGTGATCAAAATGTAAACCAT

TTATTAAACAAATTAAGTTTAGGAGATCTAAATTATATGAATCATTTAAAAAATCTGCAA

AACGAAATAAGAAACATGAATCTAGAAAAAAATTTCATGTTAGATAAAAGTAAAAAAATA

GATGAGGAAGAAAAAAAATTAGATATATTAAAAGTTAACATATCAAATATAAATAATTCT

TTAGATAAATTAAAAAAAATATTACGAAGAAGCGCTCTTTCAAAAGGTTAAAGAAAAAGCA

GAAATTCAAAAGGAAAATATAGAAAAAATAAAACAAGAAATAAATACACTCAGCGATGTT

TTTAAGAAACCATTTTTTTTTATACAACTTAATACAGATTCATCACAACATGAAAAAGAT

ATAAACAATAATGTAGAAACATATAAAAATAATATAGATGAAATATATAATGTTTTTATA

CAATCATATAATTTAATACAAAAATATTCTTCAGAAATTTTTTCATCCACCTTGAATTAT

ATACAAACAAAAGAAATAAAAGAAAAATCCATAAAGGAACAAAACCAATTAAATCAAAAT

GAAAAGGAAGCATCTGTTTTATTAAAAAATATAAAAATAAATGAAACCATAAAATTATTT

AAACAAATAAAAAATGAAAGACAAAACGATGTACACAATATAAAAGAGGACTATAACTTG

TTACAACAATATTTAAATTATATGAAAATGAAATGGAACAATTAAAAAAATATAAAAT

GATGTTCATATGGATAAAAATTATGTTGAAAATAATAATGGTGAAAAAGAAAAATTACTT

AAAGAAACCATTTCTTCATATTATGATAAAATAAATAATATAAATAATAAGCTATATATA

TATAAAAACAAAGAAGACACTTATTTTAATAATATGATCAAAGTATCAGAAATTTTAAAC

ATAATTATAAAAAAAAAACAACAAAATGAACAAAGAATTGTTATAAATGCAGAATATGAC

TCTTCATTAATTAATAAGGATGAAGAAATTAAAAAAGAAATTAATAATCAAATAATTGAA

TTAAATAAACATAATGAAAATATTTCCAATATTTTTAAGGATATACAAAATATAAAAAAA

CAAAGTCAAGATATTATCACAAATATGAACGACATGTATAAAAGTACAATCCTTTTAGTA

GACATCATACAGAAAAAGAAGAAGCTCTAAATAAACAAAAAAATATTTTAAGAAATATA

GACAATATATTAAATAAAAAAGAAAATATTATAGATAAAGTTATAAAATGTAATTGTGAT

GATTATAAAGATATCTTAATACAAAACGAAACGGAATATCAAAAATTACAAAATATAAAT

CATACATATGAAGAAAAAAAAAAATCAATAGATATATTAAAAATTAAAAATATAAAACAA

AAAAATATTCAAGAATATAAAAACAAATTAGAACAAATGAATACAATAATTAATCAAAGT

ATAGAACAACATGTATTCATAAACGCTGATATTTTACAAAATGAAAAAATAAAATTAGAA

GAAATCATAAAAAATCTAGATATACTAGATGAACAAATTATGACATATCATAATTCAATA

GATGAATTATATAAACTAGGAATACAATGTGACAATCATCTAATTACAACTATTAGTGTT
```

-continued
```
GTTGTTAATAAAAATACAACAAAAATTATGATACATATAAAAAAACAAAAAGAGGATATA

CAAAAAATTAATAACTATATTCAAACAAATTATAATATAATAAATGAAGAAGCTCTACAA

TTTCACAGGCTCTATGGACACAATCTTATAAGTGAAGATGACAAAAATAATTTGCTACAT

ATTATAAAAGAACAAAAGAATATATATACACAAAAGGAAATAGATATTTCTAAAATAATT

AAACATGTTAAAAAAGGATTATATTCATTGAATGAACATGATATGAATCATGATACACAT

ATGAATATAATAAATGAACATATAAATAATAATATTTTACAACCATACACACAATTAATA

AACATGATAAAAGATATTGATAATGTTTTTATAAAAATACAAAATAATAAATTCGAACAA

ATACAAAAATATATAGAAATTATTAAATCTTTAGAACAATTAAATAAAAATATAAACACA

GATAATTTAAATAAATTAAAAGATACACAAAACAAATTAATAAATATAGAAACAGAAATG

AAACATAAACAAAAACAATTAATAAACAAAATGAATGATATAGAAAAGGATAATATTACA

GATCAATATATGCATGATGTTCAGCAAAATATATTTGAACCTATAACATTAAAAATGAAT

GAATATAATACATTATTAAATGATAATCATAATAATAATATAAATAATGAACATCAATTT

AATCATTTAAATAGTCTTCATACAAAAATATTTAGTCATAATTATAATAAAGAACAACAA

CAAGAATATATAACCAACATCATGCAAAGAATTGATGTATTCATAAATGATTTAGATACT

TACCAATATGAATATTATTTTTATGAATGGAATCAAGAATATAAACAAATAGACAAAAAT

AAAATAAATCAACATATAAACAATATTAAAAATAATCTAATTCATGTTAAGAAACAATTT

GAACACACCTTAGAAAATATAAAAAATAATGAAAATATTTTCGACAACATACAATTGAAA

AAAAAAGATATTGACGATATTATTATAAACATTAATAATACAAAAGAAACATATCTAAAA

GAATTGAACAAAAAAAAAATGTTACAAAAAAAAAAGTTGATGAAAAAAATCAGAAATA

AATAATCATCACACATTACAACATGATAATCAAAATGTTGAACAAAAAAATAAAATTAAA

GATCATAATTTAATAACCAAGCCAAATAACAATTCATCAGAAGAATCTCATCAAAATGAA

CAAATGAAAGAACAAAACAAAAATATACTTGAAAAACAAACAAGAAATATCAAACCACAT

CATGTTCATAATCATAATCATAATCATAATCAAAATCAAAAAGATTCAACAAAATTACAG

GAACAAGATATATCTACACACAAATTACATAATACTATACATGAGCAACAAAGTAAAGAT

AATCATCAAGGTAATAGAGAAAAAAAACAAAAAAATGGAAACCATGAAAGAATGTATTTT

GCCAGTGGAATAGTTGTATCCATTTTATTTTTATTTAGTTTTGGATTTGTTATAAATAGT

AAAAATAATAAACAAGAATATGATAAAGAGCAAGAAAAACAACAACAAAATGATTTTGTA

TGTGATAATAACAAAATGGATGATAAAAGCACACAAAAATATGGTAGAAATCAAGAAGAG

GTAATGGAGATATTTTTTGATAATGATTATATTTAA
```

As a matter of routine, the skilled person will be able to identify the regions of the above nucleic acid molecules that encode the specific regions described for the Rh and EBA proteins described elsewhere herein. The present invention includes those specific nucleotide subsequences, and any alterations that are available by virtue of the degeneracy of the genetic code. Furthermore, the invention provides nucleic acid which can hybridise to these nucleic acid molecules, preferably under "high stringency" conditions (e.g. 65° C. in a 0.1×SSC, 0.5% SDS solution). Nucleic acid according to the invention can be prepared in many ways (e.g. by chemical synthesis, from genomic or cDNA libraries, from the organism itself, etc.) and can take various forms (e.g. single stranded, double stranded, vectors, probes, etc.). They are preferably prepared in substantially pure form (i.e. substantially free from other Plasmodial or host cell nucleic acids).

The term "nucleic acid" includes DNA and RNA, and also their analogues, such as those containing modified backbones (e.g. phosphorothioates, etc.), and also peptide nucleic acids (PNA), etc. The invention includes nucleic acid comprising sequences complementary to those described above (e.g. for antisense or probing purposes).

The invention also provides a process for producing an immunogenic molecule of the invention, comprising the step of culturing a host cell transformed with nucleic acid of the invention under conditions which induce polypeptide expression.

The present invention will now be more fully described by reference to the following non-limiting Examples.

EXAMPLE 1

Materials and Methods

Invasion Inhibition Assays

Methods for measuring invasion-inhibitory antibodies in serum samples have been described and evaluated in detail elsewhere [Persson, et al. J. Clin. Microbiol. (2006) 44:1665-1673]. *Plasmodium falciparum* lines 3D7-wt, 3D7ΔEBA175, W2mef-wt, W2mefΔEBA175 and W2mefSelNm were cultured in vitro as described [Beeson et al (1999) J. Infect. Dis. 180:464-472]. W2mefSelNm was generated from W2mef-wt by selection for invasion into neurmainidase-treated erythrocytes. W2mefSelNm was continuously cultured in neuraminidase-treated erythrocytes to maintain the phenotype. Synchronized (by 5% D-sorbitol) parasites were cultured with human O+erythrocytes in RPMI-HEPES medium with hypoxanthine 50 µg/ml, NaHCO3 25 mM, gentamicin 20 µg/ml, 5% v/v heat-inactivated pooled human Australian sera, and 0.25% Albumax II (Gibco, Invitrogen, Mount Waverley, Australia) in 1% O2, 4% CO2, and 95% N2 at 37° C. Invasion inhibition assays were started at late pigmented trophozoite to schizont stage. Inhibitory activity was measured over two cycles of parasite replication. Starting parasitemia was 0.2-0.3%, hematocrit 1%, and cells were resuspended in RPMI-HEPES supplemented as described above. Assays were performed in 96-well U-bottom culture plates (25 µl of cell suspension+2.5 µl of test sample/well). All samples were tested in duplicate. After 48 hours, 5 µl of fresh culture medium was added. Parasitemia was determined by flow cytometry (FACSCalibur, Becton Dickinson, Franklin Lakes, N.J.) after 80-90 hours using ethidium bromide (10 µg/ml, Bio-Rad, Hercules, Calif., USA) to label parasitised erythrocytes. Incubation time was influenced by the stage and synchronicity of parasite cultures at commencement of the assay, and by the length of the lifecycle of the parasite line used. We confirmed the inhibitory effect of treated samples by testing immunoglobulin purified from the same samples (36. All serum samples tested for inhibitory antibodies were first treated to remove non-specific inhibitors that may be present and to equilibrate pH [Persson, et al. J. Clin. Microbiol. (2006) 44:1665-1673]. Serum samples (100 µl) were dialyzed against phosphate-buffered saline (PBS; pH 7.3) in 50 kDa MWCO microdialysis tubes (2051, Chemicon, Temecula, Calif., USA) and subsequently re-concentrated to the original starting volume using centrifugal concentration tubes (100 kDa MWCO; Pall Corp., Ann Arbor, Mich., USA). Analysis of flow cytometry data was performed using FlowJo software (Tree Star Inc., Ashland, Oreg., USA). Antibodies to $MSP1_{19}$ (raised against CST fusion protein) used in the assays (at 1:10 final dilution) were generated by vaccination of rabbits and were kindly provided by Brendan Crabb. Samples from non-exposed donors were included as negative controls in all assays, and anti-MSP1 and/or anti-AMA1 antibodies acted as a positive control. Samples were tested for inhibition of the different lines in parallel in the same experiments. A difference between the lines of ≥25% in invasion was designated as the cut-off for differential inhibition by samples. Preadsorption of treated serum samples against erythrocytes did not alter their invasion-inhibitory activity. A selection of sera was also tested for antibodies to the surface of uninfected erythrocytes (maintained in culture) by flow cytometry [Beeson et al (1999) J. Infect. Dis. 180:464-472]; there was very little reactivity against normal erythrocytes and there was no relationship between antibody binding to erythrocytes with invasion-inhibitory activity.

Enzyme Treatment of Erythrocytes

Erythrocytes were first washed with RPMIHEPES/25 mM NaHCO3, pH7.4, and subsequently incubated with neurmaimidase (0.067 units/ml; Calbiochem, 45 min) or chymotrypsin (1 mg/ml; Worthington Biochemical, 15 min) at 37° C. Control treatment was RPMI-HEPES only. After incubation, chymotrypsin-treated cells were washed once with RPMI-HEPES containing 20% human serum and twice with normal culture medium (containing 5% serum) to inhibit enzyme activity. The neurmimidase-treated cells were washed with parasite culture medium three times. Treated erythrocytes were then used in invasion inhibition assays as described. All results presented are comparisons to control-treated cells.

Antibodies to Recombinant Proteins by ELISA 96-well plates (Maxisorp, Nunc, Roskilde, Denmark) were coated with recombinant GST fusion proteins at 0.5 µg/ml in PBS overnight at 4° C. Plates were washed and blocked with 10% skim milk powder (Diploma, Rowville, Australia) in PBS Tween 0.05% for 2 hours. After washing, serum samples (100 µl/well in duplicate), at 1/500 dilution in PBS Tween 0.05% plus 5% skim milk, were incubated for two hours. Plates were washed and incubated for one hour with HRP-conjugated anti-human IgG at 1/5000 (Chemicon, Melbourne, Australia) in PBS Tween 0.05% plus 5% milk. After washing, colour was developed by adding OPhenylenediamine (Sigma, Castle Hill, Australia; stopped with concentrated sulphuric acid) or azino-bis(3-ethylbenthiazoline-6-sulfonic acid) liquid substrate system (Sigma-Aldrich, Sydney; stopped with 1% SDS) and absorbance read by spectrophotometry. All washes were performed with PBS containing 0.05% Tween 20, and all incubations were at room temperature. For each serum, the absorbance from wells containing GST only was deducted from the absorbance from EBA or PfRh GST fusion proteins. Positive and negative controls were included on all plates to enable standardisation. Recombinant proteins used were EBA140 (e.g. amino acids 746-1045), EBA175 W2mef and 3D7 alleles (e.g. amino acids 761-1271), EBA181 (e.g. amino acids 755-1339), Rh4 (e.g. amino acids 1160-1370), and Rh2 (e.g. amino acids 2027-2533). Schizonts were separated on a 60% Percoll gradient, washed three times in serum-free RPMI 1640, pelleted by centrifugation and resuspended. The cells were lysed through freeze-thawing and the supernatant was preserved. Antibody reactivity of a sample was considered positive if the O.D. was >mean+3SD of the nonexposed controls.

Study Population and Serum Samples

Serum samples (50 adults and 100 children aged ≤14 years) were randomly selected from a community-based cross-sectional survey of children and adults resident in the Kilifi District, Kenya, in 1998, a year that was preceded with a relatively high incidence of malaria in the region. The area is endemic for *Plasmodium falciparum*. Samples were also obtained from non-exposed adult residents in Melbourne, Australia (n=20) and Oxford, UK (n=20). Ethical approval was obtained from the Ethics Committee of the Kenya Medical Research Institute, Nairobi, Kenya and from the Walter and Eliza Hall Institute Ethics Committee, Melbourne, Australia. All samples were obtained after written informed consent. All serum samples were tested for antibodies by ELISA. A subset of 80 of these samples was randomly selected (26% children <5 years, 49% children 6-14, 25% adults) for use in invasion inhibition assays. The same 80 samples were used in all comparative inhibition assays.

Papua New Guinea Clinical Study 206 children aged 5-14, resident in the Madang Province PNG, were enrolled and treated with artesunate to clear any existing parasitemia (Michon et al., AJTMH (2007) 76(6) .997-1008). Children were screened every 2 weeks for the presence of blood-stage parasitemia or any signs or symptoms of clinical illness. Malaria episodes were also identified at participant-initiated visit to the local health clinic. Malaria episodes were defined as presence of fever or symptoms of fever together with a parasitemia of *P. falciparum* of greater than 5000 parasiteslul. Antibodies were measured to recombinant PfRh and EBA proteins (as described above). Children were categorized into high, medium, or low responder groups to each antigen on the basis of terciles of rankings, and risk of malaria episodes from time zero to 6 months was calculated for each antibody group and plotted; FIGS. 9 and 10.

Statistical Analysis

Statistical analyses were performed with SPSS and STATA software. The chi squared test or Fischer's exact test was used for comparisons of proportions. For comparisons of continuous variables, Mann-Whitney U test or Kruskal-Wallis tests were used for non-parametric data, and t-tests or ANOVA were used for normally-distributed data, as appropriate. Associations between antibodies to recombinant antigens by ELISA and invasion-inhibitory antibodies were examined by two approaches. We tested for correlations between ELISA OD values and total invasion inhibition by samples, or the extent of differential inhibition of two comparison parasite lines, and we compared the mean or median inhibition by samples grouped as high or low responders according to reactivity by ELISA. For all analyses p<0.05 was classified as statistically significant.

EXAMPLE 2

Invasion Phenotypes and Properties of Defined *Plasmodium falciparum* Lines

Variants of the clonal parasite lines W2mef and 3D7 using different invasion pathways were used. Targeted disruption of the gene for EBA175, and selection of W2mef for invasion of neuraminidase-treated erythrocytes, generated parasites that used the SA-independent pathway. We characterised the invasion phenotypes of these parasite lines by evaluating their invasion into chymotrypsin- and neuraminidase-treated erythrocytes compared to normal erythrocytes. Clear differences between the parasite lines in invasion pathway use or phenotype were demonstrated. Invasion of the parental W2mef wild-type (wt) was sensitive to neuraminidase treatment of erythrocytes (SA-dependent invasion) but moderately resistant to chymotrypsin-treatment of erythrocytes. In contrast, invasion of W2mef with EBA175 disrupted (W2mefΔEBA175) was resistant to neuraminidase treatment (SA-independent invasion) but sensitive to chymotrypsin. Invasion of 3D7-wt and 3D7 with EBA175 disrupted (3D7ΔEBA175) was resistant to neuraminidase, but the two 3D7 lines differed in their invasion of chymotrypsin-treated erythrocytes invasion in the W2mef line, by repeated selection for invasion of neuraminidase-treated erythrocytes, was also associated with a modest reduction in multiplication rate. No substantial differences were found in the proportions of singly or multiply-infected erythrocytes (this is referred to elsewhere as the selectivity index between the different lines (data not shown). This indicates there is no major reduction in the invasion capacity of the transgenic or selected parasites compared to wild-type.

EXAMPLE 3

The Use of Alternate Erythrocyte Invasion Pathways Alters the Efficacy of Invasion-Inhibitory Antibodies Differential inhibition by acquired antibodies of isogenic lines that differ only in invasion phenotype indicates that alternate pathways may exist as a mechanism of immune evasion. Inhibitory activity of serum antibodies was compared against W2mef and 3D7 parasite lines with different invasion phenotypes. We tested serum antibodies from a selection of children (n=60) and adults (n=20) resident in a malaria-endemic region of coastal Kenya. Total invasion-inhibitory antibodies were common among this population; 68% inhibited W2mef-wt and 62% inhibited 3D7-wt by >25% compared to non-exposed controls. For these studies, differential inhibition was defined as a ≥25% difference in the extent of inhibition between the comparison lines. In all assays we tested inhibition of W2mef-wt and 3D7-wt using untreated erythrocytes, and inhibition of W2mefΔEBA175, W2mefSelNm, and 3D7ΔEBA175 was tested with untreated and neuraminidase-treated erythrocytes. We first compared serum antibody inhibition of W2mef-wt to that of W2mefΔEBA175, which has a stable, but different invasion phenotype to the parental W2mef, and has up-regulated expression of Rh4. W2mef-wt uses SA-dependent invasion mechanisms, whereas invasion of W2mefΔEBA175 is largely SA-independent. In comparative inhibition assays, we found that 27% of samples differentially inhibited the two lines (e.g. samples 56, 109, and 135 in FIG. 1A), indicating that the inhibitory activity of acquired antibodies is influenced by the invasion pathway being used (FIGS. 1A and 2A). Large differences in inhibitory activity (up to 66%) between the lines were observed for individual samples. Although W2mefΔEBA175 has switched to use a SA-independent invasion pathway, it remained possible that other ligands involved in SA-dependent invasion (e.g. EBA140, EBA181, Rh1) may still be functional to some extent in W2mefΔEBA175, despite the switch in phenotype. To inhibit these interactions, and more clearly compare antibodies against SA-dependent versus SA-independent invasion pathways, we also performed antibody inhibition assays using W2mefΔEBA175 and neuraminidase-treated erythrocytes, in comparison to inhibition of W2mef-wt with normal erythrocytes (FIG. 2B). This approach further emphasized differences in antibody activity linked to variation in invasion phenotype. The proportion of samples showing differential inhibition of the two lines was 48% versus 27% when using normal erythrocytes with both lines. The extent of differences in inhibitory activity was strongly increased for some individual samples (e.g. sample 355 in FIG. 1A). This indicates that the inhibitory activity of antibodies against ligands of SA-independent invasion was enhanced once the residual activity of SA-dependent ligands is inhibited by neuraminidase treatment of erythrocytes. Differential inhibition by samples was also observed with W2mef-wt compared to W2mefSelNm (FIGS. 1B and 2C). The latter isolate is genetically intact and its phenotype was generated by selection for invasion of neuraminidase-treated erythrocytes. Like W2mefΔEBA175, it uses an alternate SA-independent invasion pathway and has upregulated expression of Rh4. It still expresses EBA175, but does not depend on this ligand for invasion. We found 35% of samples from children and adults differentially inhibited the two lines (e.g. samples 196 and 436, FIG. 1B), confirming that a change in invasion phenotype, or pathway, can substantially alter the efficacy of inhibitory antibodies. As expected, the inhibition of W2mefSelNm and W2mefΔEBA175 by samples was highly correlated ($r=0.61$; $n=80$; $p<0.001$) as these isolates invade via the same pathway and only differ by the presence of EBA175. We also test antibodies for inhibition of W2mefSelNm invasion into neuraminidase-treated erythrocytes (FIG. 2D), compared to W2mef-wt in normal erythrocytes, to more clearly evaluate antibodies against SA-independent versus SA-dependent invasion pathways. Overall, 45% of samples differentially inhibited the two lines. Some samples showed greater differences in the inhibition of W2mef-wt and W2mefSelNm than when normal erythrocytes were used (e.g. samples 196 and 436 in FIG. 1B). Differential antibody inhibition of 3D7 lines with different invasion phenotypes further confirmed that variation in invasion phenotypes influences the activity of inhibitory antibodies (FIG. 1C and FIGS. 3, A and B). The proportion of samples that differentially inhibited parental 3D7 versus 3D7ΔEBA175 was 26% when using normal erythrocytes and 37% when using neuraminidase-treated erythrocytes with 3D7ΔEBA175. These combined results with W2mef and 3D7 lines clearly established that the availability of alternate pathways for erythrocyte invasion is immunologically important and a likely mechanism for evasion of acquired inhibitory antibodies. Antibody inhibition assays used here have been previously validated and described in detail elsewhere [Persson, et al. J. Clin. Microbiol. (2006) 44:1665-1673]. Differences in the inhibitory activity of individual sera against different parasite lines were confirmed by repeat testing. Overall, results from invasion-inhibitory assays were highly reproducible. For example, repeat testing of 33 samples for inhibition of 3D7-wt and 3D7ΔEBA175 was highly correlated (r=0.96 for 3D7-wt and r=0.94 for 3D7ΔEBA175; p<0.001). Repeat testing of 40 samples for inhibition using different parasite lines also demonstrated a high correlation between assays (r=0.83; p<0.001). We confirmed that the differential inhibitory activity measured in our assays represented inhibition of invasion, and not an effect on parasite intraerythrocytic development. To do this we tested serum samples in inhibition assays and determined parasitemias at different stages of parasite development, over one and two parasite life-cycles (data not shown). We routinely measured antibody inhibitory activity over two cycles of parasite invasion because this substantially increased the sensitivity of antibody inhibition assays and facilitated the detection of differences in inhibition between parasite lines in this study. Differential inhibition of comparison lines by sera was also observed in single-cycle assays

EXAMPLE 4

Antibodies to SA-Dependent Invasion Pathways are Common and Inhibitory Antibodies are Acquired Against EBA175

Having established that antibodies can differentially inhibit alternate invasion pathways, we next aimed to further define the acquisition of antibodies to SA-dependent invasion in the population. Of those samples that differentially inhibited W2mef-wt versus W2mefΔEBA175 (cultured with normal erythrocytes), 26 of 27 had a type-A response, inhibiting the parental W2mef more than W2mefΔEBA175 (P<0.001; FIG. 2). This pattern of inhibition points to inhibitory antibodies targeting EBA175 and other ligands of SA-dependent invasion. Overall, the mean inhibition of W2mef-wt by all samples (39.4%) was significantly greater than W2mefΔEBA175 (29.4%; p<0.01) (FIG. 2). When W2mefΔEBA175 was cultured with neuraminidase-treated erythrocytes to inhibit any residual SA-dependent interactions, there was an increase in the difference in the mean inhibition of W2mef-wt versus W2mefΔEBA175 by samples (a difference of 18.9% versus 10% using untreated erythrocytes; p<0.01; FIG. 4). Antibodies from 60% of children ≤5 years inhibited W2mef-wt to a greater extent than W2mefΔEBA175 (FIG. 2B), whereas among adults, 22% showed this pattern of inhibition (p=0.019). Similar to results from assays using W2mefΔEBA175, 31% of samples inhibited W2mefwt more than W2mefSelNm (Type A response; FIG. 2C), whereas only 4% inhibited W2mefSelNm more than W2mef-wt (p<0.001). Additionally, the mean inhibition of W2mef-wt (39.4%) by all samples was greater than W2mefSelNm (20%; p<0.01) (FIG. 4).

The SD7 parental line invades erythrocytes through largely SA-independent interactions, which limits the usefulness of this parasite line for evaluating antibodies to ligands of SA-dependent invasion. However, some samples inhibited the invasion of 3D7-wt into normal erythrocytes more than 3D7ΔEBA175 using neuraminidase-treated erythrocytes (FIG. 3B). This indicates the presence of antibodies against the ligands of SA-dependent invasion. In contrast to W2mef, disruption of EBA175 in 3D7 does not lead to a major switch in invasion phenotype. 3D7ΔEBA175 shows slightly greater resistance to the effect of neuraminidase-treatment of erythrocytes compared to 3D7-wt, and increased sensitivity to inhibition by chymotrypsin-treatment of erythrocytes, consistent with the loss of function of EBA175. Comparing inhibition of 3D7 and 3D7ΔEBA175 is therefore a useful tool to investigate inhibitory antibodies specifically targeting EBA175. Using this approach, we obtained evidence that EBA175 is a target of inhibitory antibodies, as suggested from studies with W2mef lines. 15% of children and 17% of adults inhibited 3D7-wt more than 3D7ΔEBA175 (FIG. 3A), strongly suggesting that individuals in the population have inhibitory antibodies against EBA175. These antibodies were responsible for up to 47% of the total inhibitory activity measured in some individuals (FIG. 3), indicating that EBA175 is an important target of invasion-inhibitory antibodies.

EXAMPLE 6

Inhibition of Invasion by Antibodies to Rh Proteins (e.g. Rh2 and Rh4)

We evaluated the presence of antibodies to ligands of SA-independent invasion by identifying samples that inhibited W2mefΔEBA175 or 3D7ΔEBA175 more than the corresponding parental parasites. Invasion of W2mefΔEBA175 or 3D7ΔEBA175 into neuraminidase-treated erythrocytes is dependent on ligands of the SA-independent invasion pathway. Using the W2mef line, 5% of samples (FIG. 2B) showed a type-B response and inhibited invasion of W2mefΔEBA175 into neuraminidase-treated erythrocytes more effectively than W2mef-wt. Furthermore, 13% inhibited W2mefselNm more than W2mef-wt (e.g. sample 436, FIG. 1B). Type-B responses were more prevalent with the 3D7 parasite lines than W2mef (p<0.001). A substantial number of samples inhibited 3D7ΔEBA175 more than 3D7-wt (18% of samples when using normal erythrocytes and 16% when using neuraminidase-treated erythrocytes; FIGS. 3, A and B). No children ≤5 years inhibited W2mefΔEBA175 more than W2mef-wt (FIG. 2, A and B). Samples with type-B responses were only seen among older children and adults (p=not significant).

EXAMPLE 7

Acquisition of Antibodies to Recombinant EBA and RH Proteins

Differential inhibition of parasite lines that vary in their invasion phenotype, but not genotype, indicates that members of the EBA and Rh proteins are targets of invasion-inhibitory antibodies. We measured antibodies against recombinant EBA and Rh proteins by ELISA to confirm that these proteins are targets of acquired antibodies. Antibody levels to EBA175 (both 3D7 and W2mef alleles), EBA140, EBA181, Rh2 and Rh4 were positively associated with increasing age (FIG. 6), being significantly higher among older than younger subjects (p<0.001). There was little or no reactivity of sera from malaria non-exposed subjects. Antibodies to *Plasmodium falciparum* schizont extract were also significantly correlated with age (data not shown), consistent with increasing exposure to blood-stage malaria.

EXAMPLE 8

PfRh4 is Expressed in Culture Supernatant and Binds the Surface of Erythrocytes

The following methods were used to generate data disclosed in Examples 8 to 12:

Parasite Culture and Material

*P. falciparum* asexual stages were maintained in human O+erythrocytes. 3D7 is a cloned line derived from NF54 from David Walliker at Edinburgh University. W2mef is a cloned line derived from Indochina III/CDC strain. W2mef☐175 and W2mef ☐RH4 are cloned lines containing disrupted EBA-175 gene or PfRh4 previously described in Duraisingh et al., 2003 and Stubbs et al., 2005 respectively. HB3 is a cloned line from South America.

Culture supernatants enriched in parasite invasion ligands were obtained by treating synchronized parasite cultures at 5% parasitemia with trypsin (1.0 mg/ml) and neuraminidase (66.7 mU/ml). These enzyme treatments on the erythrocytes effectively prevent reinvasion of the erythrocytes after schizont rupture. Supernatants were harvested approximately 48 hours after enzyme treatment or when it was apparent there was an absence of reinvasion, and frozen for storage at −80° C. Total proteins from schizont stage parasites were obtained by synchronization and by saponin lysis of infected erythrocytes.

Recombinant Fusions Cloning and Purification.

A codon optimised version of PfRH4 containing the DNA sequence for amino acid 28-766 was synthesized and cloned into pUC19 (Codon Devices Inc). From this clone, the region for Rh4.9 was digested out of pUC19 using BamHI and XhoI and subsequently cloned in frame into the compatible sites in pET-45b(+) which contains a amino terminus hexa-his tag. The fusion protein was expressed in BL21(DE3) (Novagen) bacterial cells and purified over a Ni-NTA column (Qiagen) in native conditions. The soluble protein expressed from Rh4.9 used in all assays underwent a second step purification where Ni-resin purified hexa-His-Rh4 was concentrated and further purified on gel-filtration column Superdex 200 (10/300 GL or Hiload 16/60, Amersham pharmacia biotech). The protein was eluted from the columns as monomer.

Recombinant fusions Rh4.10, 4.11, 4.12 and 4.13 were generated in the following way. Their respective PfRH4 fragments were amplified from a codon optimised version of PfRH4 mentioned above using the following primers: for Rh4.10 5'-cgcggatcccagcaaagaaaaga (SEQ ID NO: 15) and 5'-gcgactcgagttattaaaaatgagaacgcagatccg (SEQ ID NO: 16), for Rh4.11 5'-cgcggatcccatcgacagtgaaaacgagaagc (SEQ ID NO: 17) and 5'-gcgctcgagttattaaatctcgttcagcttattcagga (SEQ ID NO: 18), for Rh4.12 5'-cgcggatcccaagaacgagtttctgaataaattcat (SEQ ID NO: 19) and 5'-gcgagactcgagttattagatattttgcat (SEQ ID NO: 20) and for Rh4.13 5'-cgcggatcccatcaataacgacgataactttattgaat (SEQ ID NO: 21) and 5'-GCGctcgagttattatttgaacagattgattttcgtttg (SEQ ID NO: 22). The cloning and purification for these fusion proteins are as described for RH4.9.

Erythrocyte Binding and Inhibition Assay

Erythrocyte binding assays were performed in the following manner. 250 μL of culture supernatant was mixed with 50 μL of packed erythrocytes for more than 30 minutes at room temperature. The erythrocytes and parasite proteins were centrifuged at 12K rpm for 30 s through 400 μl of silicone oil (dibutyl phthalate, Sigma) to remove unbound culture supernatant material. The erythrocytes and bound proteins were washed twice with 500 ☐l of PBS. Proteins bound to the erythrocytes were eluted by incubation with 10 ☐l of 1.5 M NaCl for 15 minutes at room temperature. Then centrifuged for 30 s at 12K rpm and the eluate removed from the erythrocytes. An equal volume of 2× reducing sample buffer was added to the eluted proteins. The eluted proteins were separated on SDS PAGE and identified by immunoblotting.

Uninfected washed erythrocytes were modified with the addition of neuraminidase (66.7 mU/ml), low trypsin (0.1 mg/ml), high trypsin (1.5 mg/ml) and chymotrypsin (1.5 mg/ml) separately for one hour at 37° C. Soybean trypsin inhibitor was added to the enzyme treated erythrocytes at 1.5 mg/ml. The treated erythrocytes were subsequently washed and added to the binding assay as described above.

For the binding inhibition assay, purified anti-RH4 IgG or normal rabbit sera IgG were incubated with 250 ☐l of culture supernatant for 1 hour at room temperature before the addition of the packed erythrocytes. The rest of the binding assay was performed as described above.

Immunoblotting and Antibodies

Proteins were separated on either 3-8% Tris Acetate for proteins larger than 75 kDa or 4-12% Bis-Tris SUS-PAGE gels for smaller proteins (Invitrogen). Western blotting onto nitrocellulose (0.45 μm, Schleicher and Schueel) was performed according to standard protocols and blots were processed with an enhanced chemiluminescence system (ECL, Amersham).

Anti-Rh4 antibodies were raised in rabbits against purified Rh4.9 fusion protein. The other antibody used in immunodetection was rabbit anti-EBA-175 as in Reed et al 2000.

ELISA. 96-well flat bottom plates (Maxisorp, Nunc) were coated with recombinant fusion protein at a concentration of 1 μg/ml in HT-PBS overnight at 4° C. Plates were incubated with 10% skim milk/0.05% Tween 20 for 2 hours at 37° C. to block unspecific binding. After washing, sera samples were applied 1:500 in 5% skim milk/0.05% Tween 20. Plates were incubated for 1 hour at room temperature before sera were washed off. Secondary antibody (horseradish peroxidase conjugated goat anti-human, Chemicon) was used 1:5000 in 5% skim milk/0.05% Tween 20. Plates were incubated for 1 hour at room temperature. Azino-bis-3-ethylbenthiazoline-6-sulfonic acid (liquid substrate, Sigma-Aldrich) was used to detect HRP activity. The reaction was stopped with 1% SDS, and optical density was measured at 405 nm. All washes were done in 1×HTPBS/0.05% Tween 20. Samples were all tested in duplicate. All samples were adjusted to background reactivity determined by PBS controls.

Sera. Sera were collected from immune adults in the Madang area, Papua New Guinea. Negative control sera were obtained from unexposed Melbourne blood donors. Written consent was obtained from all donors.

Invasion Inhibition Assay

Experiments were carried out with the addition of new untreated erythrocytes or neuraminidase (66.7 mU/ml) treated erythrocytes. Enzyme treated or normal erythrocytes at 1% hematocrit in culture medium were inoculated with late trophozoite stage parasites to give a parasitemia of 0.2% and hematocrit of 1% in a volume of 50 ☐l. The parasites were cultured in 96 well round bottom microtiter plates (Becton Dickinson, N.J.). Antibodies used for the assay were purified using protein G affinity columns. Antibodies were added to a final concentration of 2 mg/ml during the setup of the assay, prior to reinvasion. For the antibody titration invasion inhibition assay, anti-PfRh4 IgG or IgG from normal rabbit serum were added to a final concentration of 0, 0.05, 0.10, 0.22, 0.45, 0.90, 1.50 and 2.00 mg/ml (amount of IgG antibodies/55 µl of final culture volume). After incubation with antibodies for 2 cycles of parasite growth, the parasitemia of each well was counted by flow cytometry of ethidium bromide (Biorad, Calif.) stained trophozoite stage parasites using a FACSCalibur with a plate reader (Becton Dickinson, N.J.). For each well 40,000 cells or more was counted. Growth was expressed as a percentage of the parasitaemia for the mean of 2 or more PBS, rabbit prebleed or nonimmune IgG wells as appropriate. Two independent assays were performed, each in duplicate.

To determine if PfRH4 is present as an invasion ligand in culture supernatants, we analysed its expression using a mouse monoclonal antibody in supernatants made from the 3D7, HB3, W2mefΔRH4 and W2mefΔ175 strains. We detected the presence of a single band at 160 kDa in supernatants made from 3D7, HB3 and W2mefΔ175 which expresses PfRh4 but not from supernatant made from W2mefΔRH4 strain, which does not express PfRH4 (FIG. 13, right panel). This same antibody detected the expected doublet band at 190 kDa and 180 kDa in saponin treated schizont pellet in the 3D7, HB3 and W2mefΔ175 strains and an absence of the doublet in the W2mefΔRH4 strain (FIG. 13A, left panel, Stubbs et al). Three other anti-RH4 antibodies raised to distinct regions of PfRh4 showed similar differences in protein migration between saponin treated schizont pellets and culture supernatants (FIG. 18).

If PfRH4 is to function as an invasion ligand, it should have the capability of binding to the surface of erythrocytes. To determine if PfRH4 binds to the surface of erythrocytes, we performed an erythrocyte binding assay. Briefly 3D7 invasion supernatants were incubated with human erythrocytes. The erythrocytes and parasite proteins were passed through oil and bound proteins were eluted using high salt conditions and the eluate was analysed by immunoblotting. Incubation of 3D7 invasion supernatants with untreated erythrocytes showed that PfRh4 binds erythrocytes (FIG. 13B). The specificity of binding was further determined by modifying the surface of the erythrocytes with neuraminidase, low trypsin (0.1 mg/ml), high trypsin (1.5 mg/ml) and chymotrypsin enzyme treatments. Treatment with neuraminidase, which removes sialic acid moieties from the cell surface, did not perturb binding of PfRH4. However, binding of PfRh4 was abolished when erythrocytes were treated with trypsin and chymotrypsin indicating that the receptor for PfRh4 is neuraminidase resistant, trypsin sensitive and chymotrypsin sensitive (FIG. 1B, top panel). The same binding eluates were probed with an anti-EBA-175 antibody (FIG. 13B, bottom panel). It showed that EBA-175 bound to untreated erythrocytes but not to neuraminidase treated erythrocytes, serving as controls for the specificity of the enzyme treatments and any non-specific carryover of invasion ligands into the binding eluates (FIG. 13B).

EXAMPLE 9

PfRH4 Binds to the Erythrocyte Surface Through its N-Terminal Region

The Rh family of proteins consists of several high molecular weight proteins, PfRh4 itself being a 205 kDa protein. To narrow down the binding domain of PfRH4, we expressed a 88 kDa region of PfRH4 (amino acid 28-766), tagged it with a amino terminus hexa-his tag and called it RH4.9 (FIG. 14A). We expressed this recombinant protein in bacteria cells, purified the soluble fraction using a Ni-NTA column and performed a second step purification on gel filtration column. The protein preparation was confirmed by mass spectroscopy analyses (data not shown). When RH4.9 was incubated with untreated erythrocytes in an erythrocyte binding assay, we found that it bound to the surface of the erythrocytes (FIG. 14B). Furthermore, RH4.9 bound to erythrocytes treated with neuraminidase but not to erythrocytes treated with trypsin and chymotrypsin. These binding characteristics are identical to the enzyme specificity seen with native PfRH4 binding showing that this 88 kDa region of PfRH4 is sufficient for binding to erythrocytes and recognition of the PfRH4 erythrocyte receptor.

To further delineate the binding region of PfRH4, we expressed three overlapping recombinant proteins spanning Rh4.9; Rh4.10 (aa 28-340), Rh4.11 (aa 233-540) and (FIG. 14A). In addition we expressed a region of PfRH4 that contain homology to *P. vivax* reticulocyte binding protein 1 (PvRBP1) in RH4.13 (aa 283-642) and showed that this recombinant protein also bound erythrocytes. Combining all these analyses we propose that a region required for PfRh4 binding is present between amino acid 233-282.

EXAMPLE 10

Reactivity of Recombinant Rh4 with Human Immune Sera

To determine whether antibodies against an erythrocyte binding region of PfRh4 were elicited during a natural infection with *P. falciparum*, Rh4.9 fusion protein which contains the erythrocyte binding domain, was tested for reactivity with sera collected from immune individuals from the Madang area in Papua New Guinea. Each serum sample was incubated separately against purified RH4.9 protein. Using an ELISA based assay, we measured the level of antibodies in sera from 13 adult residents of Madang (Papua New Guinea) who had various degrees of past exposure to *P. falciparum* (FIG. 15, numbered samples). We found that all immune individuals in this set had a positive response to recombinant RH4.9. Substantial levels of antibodies (OD405>0.5) were detected in 9/13 sera from these infected individuals. ELISA-determined OD levels of IgG antibodies against recombinant Rh4.9 in sera from malaria-exposed individuals were significantly higher than those measured in sera from non-malaria exposed indivisuals resident in Melbourne, Australia (M1-M7).

EXAMPLE 11

Antibodies to Rh4 Binding Domain Inhibit PfRH4 Binding to the Surface of Erythrocytes We wanted to determine if antibodies raised to the binding region of RH4 have the ability to inhibit native PfRH4 erythrocyte binding capabilities. To this end, rabbit polyclonal antisera were raised against recombinant fusion RH4.9. IgG purified anti-RH4 antibodies were incubated with western blots of parasite associated proteins isolated from saponin lysis and as well as parasite proteins released into culture supernatants. As expected the anti-Rh4 antibodies detect the doublet bands in saponin treated schizont pellets and a singlet 160 kDa band within culture supernatants (data not shown).

For the erythrocyte binding antibody inhibition assay, we preincubated IgG purified anti-Rh4 antibodies in varying final concentrations (0.2-100 mg) with 3D7 culture supernatants before proceeding with the standard erythrocyte binding assay. In FIG. 16A, we show that native PfRH4 binding to the surface of erythrocytes was blocked by the addition of anti-Rh4 antibodies. As increasing amounts of anti-Rh4 antibodies were added, the inhibition of PfRh4 binding to erythrocytes was also enhanced. Complete inhibition of binding was attained when the concentration of more than 12 mg of antibody was used (FIG. 19). The same binding eluates were probed with anti-EBA-175 antibodies and show that EBA-175 binding to erythrocytes was not at all perturbed, evidence that the inhibition is specific to PfRH4 (FIG. 16B). In addition, similar concentrations of purified IgG normal rabbit serum used in the erythrocyte binding assay did not cause any inhibition of PfRh4 erythrocyte binding lending further support that the anti-Rh4 antibody inhibition is not due to a general steric hindrance caused by the binding of non-specific antibodies to invasion proteins (FIG. 16C, FIG. 19).

EXAMPLE 12

Antibodies to Rh4 Binding Domain Inhibit Parasite Invasion

Since anti-RH4 antibodies block native PfRH4 binding to erythrocytes, we wanted to determine if these antibodies could inhibit parasite invasion in vitro. We analysed the effects on invasion on four parasite strains, two sialic acid dependent strains W2mef, W2mefΔRH4 and two sialic acid independent strains 3D7 and W2mefΔ175. Upon incubation of anti-RH4 antibodies with the parasite strains and untreated erythrocytes, only 3D7 showed moderate inhibition of parasite invasion (23%, FIG. 17A). As parasites utilize several different invasion pathways, we treated the erythrocytes with neuraminidase prior to the invasion assay to force the parasites to invade via a sialic acid independent pathway. As a result, parasite invasion of erythrocytes for the sialic acid dependent parasite strains W2mef and W2mefΔRH4 was greatly inhibited; therefore these strains were removed from further analyses. However, erythrocyte invasion of the parasite lines 3D7 and W2mefΔ175 was substantially inhibited by antibodies to Rh4 when erythrocytes had been first were treated with neuraminidase (FIG. 17B). Inhibition of parasite invasion increased with further rabbit bleeds with third bleeds giving up to 78% inhibition in 3D7 and 49% inhibition in W2mefΔ175, showing that increased inhibition may be correlated with increased immune response to PfRH4.

To determine what effect antibody concentration would have in invasion inhibition, we titrated out the amount of purified IgG from 100 to 0 mg for each invasion assay. As seen in FIG. 17C, addition of more anti-RH4 antibodies resulted in an increase in invasion inhibition with 3D7 grown in neuraminidase treated erythrocytes (black circles). As a control, similar amounts of purified IgG from normal (non-immunized) rabbit sera were added to the assay and it did not have any effect on 3D7 parasite invasion into erythrocytes (FIG. 17C, white squares). This result shows that the invasion inhibition observed using anti-Rh4 antibodies is not an experimental artefact due to the addition of IgG antibodies into the parasite culture.

Examples 8 to 12 demonstrate that: Invasion pathways of *Plasmodium falciparum* into human erythrocytes may rely on the interaction between multiple parasite ligands with their respective erythrocyte receptors. The sialic acid independent invasion pathway is dependent on the expression of *P. falci-parum* reticulocyte-binding like homolog 4 (PfRh4). We show that PfRh4 is present as an invasion ligand in culture supernatants. PfRh4 binds to the surface of erythrocytes through recognition of an erythrocyte receptor that is neuraminidase resistant but trypsin and chymotrypsin sensitive. Our erythrocyte binding studies also define the minimal binding domain within PfRH4. Sera from infected individuals show reactivity against the binding domain of PfRH4. Purified IgG rabbit antibodies raised to the binding domain of PfRH4 have the ability to block native PfRh4 from binding to the surface of erythrocytes. Furthermore, these antibodies inhibit parasite invasion in vitro in sialic acid independent strains. These results support the utility of PfRH4 as an immunogenic molecule in a vaccine composition.

EXAMPLE 13

Inhibition of *P. falciparum* by Serum Antibodies From Adults 3D7 wt Versus 3D7 with Disruption of PfRh2a or PfRh2b Serum antibodies were tested for their ability to inhibit erythrocyte invasion of 3D7-wild type parasites or 3D7 parasites with disruption of PfRh2a or PfRh2b. Serum samples were obtained from Kenyan adults. Results suggests that some people have inhibitory antibodies that target PfRh2b (samples inhibited invasion of the 3D7-wt or the 3D7-Rh2a-KO line greater than the 3D7-PfRh2b line).

EXAMPLE 14

Association Between Antibodies and Risk of Clinical *P. falciparum* Malaria

The table below demonstrates an association between levels of IgG, IgG1, and/or IgG3 to PfRH2 and PfRH4 proteins and protection against symptomatic *P. falciparum* malaria. 206 children were enrolled, treated to clear parasitemia and followed by active and passive surveillance for 6 months to identify re-infection and episodes of symptomatic malaria (Michon et al., Am J Trop Med Hyg, 2007). Antibodies were tested from samples collected at baseline. Children were stratified into groups of low, moderate and high responders (based on tertiles) based on their antibody level determined by ELISA and associations between antibodies and risk of symptomatic malaria were analysed prospectively. Symptomatic malaria was defined as parasitemia >5000 parasites/μl and fever. Values represent hazard ratios (using Cox proportional hazards method). "Spatially adj1dsea" denotes spatial adjustment for distance from sea.

| Protein | Total IgG Hazard ratio | p value | IgG1 Hazard ratio | p value | IgG3 Hazard ratio | p value |
|---|---|---|---|---|---|---|
| Rh2a-b(1) Aa1288-1856 | | | | | | |
| unadjusted | 0.441 | 0.006 | | | | |
| Age adjusted | 0.479 | 0.013 | | | | |
| Spatially adj1dsea | 0.485 | 0.015 | | | | |
| Rh2a-b(2) Aa297-726 | | | | | | |
| unadjusted | 0.502 | 0.024 | | | | |

| Protein | Total IgG Hazard ratio | p value | IgG1 Hazard ratio | p value | IgG3 Hazard ratio | p value |
|---|---|---|---|---|---|---|
| Age adjusted | 0.481 | 0.016 | | | | |
| Spatially adj1dsea Rh2a-b(3) Aa34-322 | 0.561 | 0.059 | | | | |
| unadjusted | 0.362 | 0.001 | | | | |
| Age adjusted | 0.425 | 0.008 | | | | |
| Spatially adj1dsea Rh2a-b(4) Aa673-1288 | 0.429 | 0.009 | | | | |
| unadjusted | 0.241 | <0.001 | | | | |
| Age adjusted | 0.231 | <0.001 | | | | |
| Spatially adj1dsea Rh2a-9 Aa2030-2528 | 0.272 | <0.001 | | | | |
| unadjusted | 0.317 | 0.001 | 0.456 | 0.010 | 0.465 | 0.014 |
| Age adjusted | 0.285 | <0.001 | 0.448 | 0.009 | 0.502 | 0.027 |
| Spatially adj1dsea Rh2a-11 Aa2530-3029 | 0.344 | 0.002 | 0.504 | 0.027 | 0.602 | 0.124 |
| unadjusted | 0.389 | 0.002 | 0.307 | <0.001 | 0.425 | 0.004 |
| Age adjusted | 0.375 | 0.002 | 0.274 | <0.001 | 0.398 | 0.002 |
| Spatially adj1dsea Rh2b Aa2792-3185 | 0.439 | 0.007 | 0.329 | 0.001 | 0.495 | 0.022 |
| unadjusted | 0.283 | <0.001 | | | | |
| Age adjusted | 0.321 | <0.001 | | | | |
| Spatially adj1dsea Rh4A3 Aa1277-1451 | 0.313 | <0.001 | | | | |
| unadjusted | 0.234 | <0.001 | | | | |
| Age adjusted | 0.254 | <0.001 | | | | |
| Spatially adj1dsea Rh4WH Aa29-766 | 0.275 | <0.001 | | | | |
| unadjusted | 0.435 | 0.009 | 0.380 | 0.004 | 0.283 | <0.001 |
| Age adjusted | 0.399 | 0.004 | 0.341 | 0.001 | 0.318 | 0.001 |
| Spatially adj1dsea | 0.464 | 0.017 | 0.407 | 0.008 | 0.336 | 0.001 |

EXAMPLE 15

Inhibition of *P. falciparum* by Serum Antibodies from Children 3D7 wt Versus 3D7 with Disruption of PfRh2a or PfRh2b Serum antibodies were tested for their ability to inhibit erythrocyte invasion of 3D7-wild type parasites or 3D7 parasites with disruption of PfRh2a or PfRh2b (methods described by Persson et al., J. Clin. Invest. 2008). Serum samples were obtained from Kenyan children. Results suggests that some people have inhibitory antibodies that target PfRh2b (samples inhibited invasion of the 3D7-wt or the 3D7-Rh2a-KO line greater than the 3D7-PfRh2b line)

While the foregoing written description of the invention enables one of ordinary skill to make and use what is considered presently to be the best mode thereof, those of ordinary skill will understand and appreciate the existence of variations, combinations, and equivalents of the specific embodiment, method, and examples herein. The invention should therefore not be limited by the above described embodiment, method, and examples, but by all embodiments and methods within the scope and spirit of the invention as broadly described herein.

SEQUENCE LISTING (52 sequences)

SEQ ID NO: 1 - protein, 3179 aa, Plasmodium falciparum
MKRSLINLENDLFRLEPISYIQRYYKKNINRSDIFHNKKERGSKVYSNVSSFHSFIQEGKEEVEVFSIWGSNSVLDHIDVLRDNGTVVFSVQPYYLDIYTCKEAILFTTSFYKDLDKSSITKINEDIEKFNEEIIKNEEQCLVGGKTDFDNLLIVLENAEKANVRKTLFDNTFNDYKNKKSSFYNCLKNKKNDYDKKIKNIKNEITKLLKNIESTGNMCKTESYVMNNNLYLLRVNEVKSTPIDLYLNRAKELLESSSKLVNPIKMKLGDNKNMYSIGYIHDEIKDIIKRYNFHLKHIEKGKEYIKRITQANNIADKMKKDELIKKIFESSKHFASFKYSNEMISKLDSLFIKNEEILNNLFNNIFNIFKKKYETYVDMKTIESKYTTVMTLSEHLLEYAMDVLKANPQKPIDPKANLDSEVVKLQIKINEKSNELDNAISQVKTLIIIMKSFYDIIISEKASMDEMEKKELSLNNYIEKTDYILQTYNIFKSKSNIINNNSKNISSKYITIEGLKNDIDELNSLISYFKDSQETLIKDDELKKNMKTDYLNNVKYIEENVTHINEIILLKDSITQRIADIDELNSLNLININDFINEKNISQEKVSYNLNKLYKGSFEELESELSHFLDTKYLFHEKKSVNELQTILNTSNNECAKLNFMKSDNNNNNNNSNIINLLKTELSHLLSLKENIIKKLLNHIEQNIQNSSNKYTITYTDINNRMEDYKEEIESLEVYKHTIGNIQKEYILHLYENDKNALAVHNTSMQILQYKDAIQNIKNKISDDIKILKKYKEMNQDLLNYYEILDKKLKDNTYIKEMHTASLVQITQYIPYEDKTISELEQEFNNNNQKLDNILQDINAMNLNINILQTLNIGINACNTNNKNVEHLLNKKIELKNILNDQMKIIKNDDIIQDNEKENFSNVLKKEEEKLEKELDDIKFNNLKMDIHKLLNSYDHTKQNIESNLKINLDSFEKEKDSWVHFKSTIDSLYVEYNICNQKTHNTIKQQKNDIIELIYKRIKDINQEIIEKVDNYYSLSDKALTKLKSIHFNIDKEKYKNPKSQENIKLLEDRVMILEKKIKEDKDALIQIKNLSHDHFVNADNEKKKQKEKEEDDEQTHYSKKRKVMGDIYKDIKKNLDELNNKNLIDITLNEANKIESEYEKILIDDICEQITNEAKKSDTIKEKIESYKKDIDYVDVDVSKTRNDHHLNGDKIHDSFFYEDTLNYKAYFDKLKDLYENINKLTNESNGLKSDAHNNNTQVDKLKEINLQVFSNLGNIIKYVEKLENTLHELKDMYEFLETIDINKILKSIHNSMKKSEEYSNETKKIFEQSVNITNQFIEDVEILKTSINPNYESLNDDQIDDNIKSLVLKKEEISEKRKQVNKYITDIESNKEQSDLHLRYASRSIYVIDLFIKHEIINPSDGKNFDIIKVKEMINKTKQVSNEAMEYANKMDEKNKDIIKIENELYNLINNNIRSLKGVKYEKVRKQARNAIDDINNIHSNIKTILTKSKERLDEIKKQPNIKREGDVLNNDKTKIAYITIQINNGRIESNLLNILNMKHNIDTILNKAMDYMNDVSKSDQIVINIDSLNMNDIYNKDKDLLINILKEKQNMEAEYKKMNEMYNYVNETEKEIIKHKKNYEIRIMEHIKKETNEKKKKFMESNNKSLTTLMDSFRSMFYNEYINDYNINENFEKHQNILNEIYNGFNESYNIINTKMTEIINDNLDYNEIKEIKEVAQTEYDKLNKKVDELKNYLNNIKEQEGHRLIDYIKEKIFNLYIKCSEQQNIIDDSYNYITVKKQYIKTIEDVKFLLDSLNTIEEKNKSVANLEICTNKEDIKNLLKHVIKLANFSGIIVMSDTNTEITPENPLEDNDLLNLQLYFERKHEITSTLENDSDLELDHLGSNSDESIDNLKVYNDIIELHTYSTQILKYLDNIQKLKGDCNDLVKDCKELRELSTALYDLKIQITSVINRENDISNNIDIVSNKLNEIDAIQYNFEKYKEIFDNVEEYKTLDDTKNAYIVKKAEILKNVDINKTKEDLDIYFNDLDELEKSLTLSSNEMEIKTIVQNSYNSFSDINKNINDIDKEMKTLIPMLDELLNEGHNIDISLYNFIIRNIQIKIGNDIKNIREQENDTNICFEYIQNNYNFIKSDISIFNKYDDHIKVDNYISNNIDVVNKHNSLLSEHVINATNIIENIMTSIVEINEDTEMNSLEETQDKLLELYENFKKEKNIINNNYKIVHFNKLKEIENSLETYNSISTNFNKINETQNIDILKNEFNNIKTKINDKVKELVHVDSTLTLESIQTFNNLYGDLMSNIQDVYKYEDINNVELKKVKLYIENITNLLGRINTFIKELDKYQDENNGIDKYIEINKENNSYIIKLKEKANNLKENFSKLLQNIKRNETELYNINNIKDDIMNTGKSVNNIKQKFSSNLPLKEKLFQMEEMLLNINNIMNETKRISNTDAYTNITLQDIENNKNKENNNMNIETIDKLIDHIKIHNEKIQAEILIIDDAKRKVKEITDNINKAFNEITENYNNENNGVIKSAKNIVDKATYLNNELDKFLLKLNELLSHNNNDIKDLGDEKLILKEEEERKERERLEKAKQEEERKERERIEKEKQEKERLEREKQEQLKKEALKKQEQERQEQQQKEEALKRQEQERLQKEEELKRQEQERLEREKQEQLQKEEELRKKEQEKQQQRNIQELEEQKKPEIINEALVKGDKILEGSDQRNMELSKPNVSMDNTNNSPISNSEITESDDIDNSENIHTSHMSDIESTQTSHRSNTHGQQISDIVEDQITHPSNIGGEKITHNDEISITGERNNISDVNDYSESSNIFENGDSTINTSTRNTSSTHDESHISPISNAYDHVVSDNKKSMDENIKDKLKIDESITTDEQIRLDDNSNIVRIDSTDQRDASSHGSSNRDDDEISHVGSDIHMDSVDIHDSIDTDENADHRHNVNSVDSLSSSDYTDTQKDFSSIIKDGGNKEGHAENESKEYESQTEQTHEEGIMNPNKYSISEVDGIKLNEEAKHKITEKLVDIYPSTYRTLDEPMETHGPNEKFHMFGSPYVTEEDYTEKHDYDKHEDFNNERYSNHNKMDDFVYNAGGVVCCVLFFASITFFSMDRSNKDECDFDMCEEVNNNDHLSNYADKEEIIEIVFDENEEKYF

SEQ ID NO: 2 - DNA, 9540 bp, Plasmodium falciparum
atgaagagatcgcttataaatttagaaaatgatctttttagattagaacctatatcttatattcaaagatattataagaagaatataaacagatctgatatttttcataataaaaaagaaagaggttccaaagtatattcaaatgtgtcttcattccattcttttattcaagagggtaaagaagaagttgaggttttttctatatggggtagtaatagcgttttagatcatatagatgttcttagggataatggaactgtcgttttttctgttcaaccatattaccttgatatatatacgtgtaaagaagccatattatttactacatcattttacaaggatcttgataaaagttcaattacaaaaattaatgaagatattgaaaaatttaacgaagaaataatcaagaatgaagaacaatgtttagttggtgggaaaacagattttgataatttacttatagttttagaaaatgcggaaaaagcaaatgttagaaaaacattatttgataatacatttaatgattataaaaataagaaatctagtttttacaattgtttgaaaaataaaaaaaatgattatgataagaaaataaagaatataaagaatgagattacaaaattgttaaaaaatattgaaagtacaggaaatatgtgtaaaacggaatcatatgttatgaataataatttatatctattaagagtgaatgaagttaaaagtacacctattgatttatacttaaatcgagcaaaagagctattagaatcaagtagcaaattagttaatcctataaaaatgaaattaggtgataataagaacatgtactctattggatatatacatgacgaaattaaagatattataaaaagatataattttcatttgaaacatatagaaaaaggaaaagaatatataaaaaggataacacaagcaaataatattgcagacaaaatgaagaaagatgaacttataaaaaaaatttttgaatcctcaaaacattttgctagttttaaatatagcaatgaaatgataagcaaattagattcgttatttataaaaaatgaagaaatacttaataatttattcaataatatatttaatatattcaagaaaaaatatgaaacatatgtagatatgaaaacaattgaatctaaatatacaacagtaatgactctatcagaacatttattagaatatgcaatggatgttttaaaagctaaccctcaaaaacctattgatccaaaagcaaatctggattcagaagtagtaaaattacaaataaaaataaatgagaaatcaaatgaattagataatgctataagtcaagtaaaaacactaataataataatgaaatcattttatgatattattatatctgaaaaagcctctatggatgaaatggaaaaaaaggaattatccttaaataattatattgaaaaaacagattatatattacaaacgtataatatttttaagtctaaaagtaatattataaataataatagtaaaaatattagttctaaatatataactatagaagggttaaaaaatgatattgatgaattaaatagtcttatatcatattttaaggattcacaagaaacattaataaaagatgatgaattaaaaaaaaacatgaaaacggattatcttaataacgtgaaatatatagaagaaaatgttactcatataaatgaaattatattattaaaagattctataactcaacgaatagcagatattgatgaattaaatagtttaaatttaataaatataaatgattttataaatgaaaagaatatatcacaagagaaagtatcatataatcttaataaattatataaaggaagttttgaagaattagaatctgaactatctcattttttagacacaaaatatttgtttcatgaaaaaaaaagtgtaaatgaacttcaaacaattttaaatacatcaaataatgaatgtgctaaattaaattttatgaaatctgataataataataataataataatagtaatataattaacttgttaaaaactgaattaagtcatctattaagtcttaaagaaaatataataaaaaaacttttaaatcatatagaacaaaatattcaaaactcatcaaataagtatactattacatatactgatattaataatagaatggaagattataaagaagaaatcgaaagtttagaagtatataaacataccattggaaatatacaaaaagaatatatattacatttatatgagaatgataaaaatgctttagctgtacataatacatcaatgcaaatattacaatataaagatgctatacaaaatataaaaaataaaatttctgatgatataaaaattttaaagaaatataaagaaatgaatcaagatttattaaattattatgaaattctagataaaaaattaaaagataatacatatatcaaagaaatgcatactgcttctttagttcaaataactcaatatattccttatgaagataaaacaataagtgaacttgagcaagaatttaataataataatcaaaaacttgataatatattacaagatatcaatgcaatgaatttaaatataaatattctccaaaccttaaatattggtataaatgcatgtaatacaaataataaaaatgtagaacacttacttaacaagaaaattgaattaaaaaatatattaaatgatcaaatgaaaattataaaaaatgatgatataattcaagataatgaaaaagaaaacttttcaaatgttttaaaaaaagaagaggaaaaattagaaaaagaattagatgatatcaaatttaataatttgaaaatggacattcataaattgttgaattcgtatgaccatacaaagcaaaatatagaaagcaatcttaaaataaatttagattctttcgaaaaggaaaaagatagttgggttcattttaaaagtactatagatagtttatatgtggaatataacatatgtaatcaaaagactcataatactatcaaacaacaaaaaaatgatatcatagaacttatttataaacgtataaaagatataaatcaagaaataatcgaaaaggtagataattattattccctgtcagataaagccttaactaaacttaaatctattcattttaatattgataaggaaaaatataaaaatcccaaaagtcaagaaaatattaaattattagaagatagagttatgatacttgagaaaaagattaaggaagataaagatgctttaatacaaattaagaatttatcacatgatcattttgtaaatgctgataatgagaaaaaaaagcagaaggagaaggaggaggacgacgaacaaacacactatagtaaaaaaagaaaagtaatgggagatatatataaggatattaaaaaaaacctagatgagttaaataataaaaatttgatagatattactttaaatgaagcaaataaaatagaatcagaatatgaaaaaatattaattgatgatatttgtgaacaaattacaaatgaagcaaaaaaaagtgatactattaaggaaaaaatcgaatcatataaaaaagatattgattatgtagatgtggacgtttccaaaacgaggaacgatcatcatttgaatggagataaaatacatgattcttttttttatgaagatacattaaattataaagcatattttgataaattaaaagatttatatgaaaatataaacaagttaacaaatgaatcaaatggattaaaaagtgatgctcataataacaacacacaagttgataaactaaaagaaattaatttacaagtattcagcaatttaggaaatataattaaatatgttgaaaaacttgagaatacattacatgaacttaaagatatgtacgaatttctagaaacgatcgatattaataaaatattaaaaagtattcataatagcatgaagaaatcagaagaatatagtaatgaaacgaaaaaaatatttgaacaatcagtaaatataactaatcaatttatagaagatgttgaaatattgaaaacgtctattaacccaaactatgaaagcttaaatgatgatcaaattgatgataatataaaatcacttgttctaaagaaagaggaaatatccgaaaaaagaaaacaagtgaataaatacataacagatattgaatctaataaagaacaatcagatttacatttacgatatgcatctagaagtatatatgttattgatctttttataaaacatgaaataataaatcctagcgatggaaaaaattttgatattataaaggttaaagaaatgataaataaaaccaaacaagtttcaaatgaagctatggaatatgctaataaaatggatgaaaaaaataaggacattataaaaatagaaaatgaactttataatttaattaataataacatccgttcattaaaaggggtaaaatatgaaaaagttaggaaacaagcaagaaatgcaattgatgatataaataatatacattctaatattaaaacgattttaaccaaatctaaagaacgattagatgagattaagaaacaacctaacattaaaagagaaggtgatgttttaaataatgataaaaccaaaatagcttatattacaatacaaataaataacggaagaatagaatctaatttattaaatatattaaatatgaaacataacatagatactatcttgaataaagctatggattatatgaatgatgtatcaaaatctgaccagattgttattaatatagattctttgaatatgaacgatatatataataaggataaagatcttttaataaatattttaaaagaaaaacagaatatggaggcagaatataaaaaaatgaatgaaatgtataattacgttaatgaaacagaaaaagaaataataaaacataaaaaaaattatgaaataagaattatggaacatataaaaaaagaaacaaatgaaaaaaaaaaaaaatttatggaatctaataacaaatcattaactactttaatggattcattcagatctatgttttataatgaatatataaatgattataatataaatgaaaattttgaaaaacatcaaaatatattgaatgaaatatataatggatttaatgaatcatataatattattaatacaaaaatgactgaaattataaatgataatttagattataatgaaataaaagaaattaaagaagtagcacaaacagaatatgataaacttaataaaaaagttgatgaattaaaaaattatttgaataatattaaagaacaagaaggacatcgattaattgattatataaaagaaaaaatatttaacttatatataaaatgttcagaacaacaaaatataatagatgattcttataattatattacagttaaaaaacagtatattaaaactattgaagatgtgaaatttttattagattcattgaacacaatagaagaaaaaaataaatcagtagcaaatctagaaatttgtactaataaagaagatataaaaaatttacttaaacatgttataaagttggcaaatttttcaggtattattgtaatgtctgatacaaatacggaaataactccagaaaatcctttagaagataatgatttattaaatttacaattatattttgaaagaaaacatgaaataacatcaacattggaaaatgattctgatttagagttagatcatttaggtagtaattcggatgaatctatagataatttaaaggtttataatgatattatagaattacacacatattcaacacaaattcttaaatatttagataatattcaaaaacttaaaggagattgcaatgatttagtaaaggattgtaaagaattacgtgaattgtctacggcattatatgatttaaaaatacaaattactagtgtaattaatagagaaaatgatatttcaaataatattgatattgtatctaataaattaaatgaaatagatgctatacaatataattttgaaaaatataaagaaatttttgataatgtagaagaatataaaacattagatgatacaaaaaatgcatatattgtaaaaaaggctgaaattttaaaaaatgtagatataaataaaacaaaagaagatttagatatatattttaatgacttagacgaattagaaaaatctcttacattatcatctaatgaaatggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggatgcatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgataaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagagagagaaagaatagaaaaagaaaaacaagagaaagaaagactggaaagagagaaacaagaacaactaaaaaaagaagcattaaaaaaacaagagcaagaaagacaagaacaacaacaaaaagaagaagcattaaaaagacaagaacaagaacgactacaaaaagaagaagaattaaaaagacaagagcaagaaaggctggaaagagagaaacaagaacaactacaaaaagaagaagaattaagaaaaaaagagcaggaaaaacaacaacaaagaaatatccaagaattagaagagcaaaaaaagcctgaaataataaatgaagcattggtaaagggggataaaatactagaaggaagtgatcagagaaatatggaattaagcaaacctaacgttagtatggataatactaataatagtccaattagtaacagtgaaattacagaaagcgatgatattgataacagtgaaaatatacatactagtcatatgagtgacatcgaaagtacacaaactagtcatagaagtaacacccatgggcaacaaatcagtgatattgttgaagatcaaattacacatcctagtaatattggaggagaaaaaattactcataatgatgaaatttcaatcactggtgaaagaaataacattagcgatgttaatgattatagtgaaagtagcaacatatttgaaaatggtgacagtactataaataccagtacaagaaacacgtctagtacacatgatgaatcccatataagtcctatcagcaatgcgtatgatcatgttgtttcagataataaaaaaagtatggatgaaaacataaaagataaattaaagatagatgaaagtataactacagatgaacaaataagattagatgataattctaatattgttagaattgatagtactgaccaacgtgatgctagtagtcatggtagtagtaatagggatgatgatgaaataagtcatgttggtagcgacattcatatggatagtgttgatattcatgatagtattgacactgatgaaaatgctgatcacagacataatgttaactctgttgatagtcttagttctagtgattacactgatacacagaaagactttagtagtattattaaagatgggggaaataaagaaggacatgctgagaatgaatctaaagaatatgaatcccaaacagaacaaacacatgaagaaggaattatgaatccaaataaatattcaattagtgaagttgatggtattaaattaaatgaagaagctaaacataaaattacagaaaaactggtagatatctatccttctacatatagaacacttgatgaacctatggaaacacatggtccaaatgaaaaatttcatatgtttggtagtccatatgtaacagaagaagattacacggaaaaacatgattatgataagcatgaagatttcaataatgaaaggtattcaaaccataacaaaatggatgatttcgtatataatgctggaggagttgtttgttgtgtattattttttgcaagtattactttcttttctatggacagatcaaataaggatgaatgcgattttgatatgtgtgaagaagtaaataataatgatcacttatcgaattatgctgataaagaagaaattattgaaattgtgtttgatgaaaatgaagaaaaatatttttaa

SEQ ID NO: 3 - protein, 1716 aa, Plasmodium falciparum
MNKNILWITFFYFLFFLLDMYQGNDAIPSKEKKNDPEADSKNSQNQHDINKTHHTNNNYDLNIKDKDEKKRKNDNLINNYDYSLLKLSYNKNQDIYKNIQNGQKLKTDIILNSFVQINSSNILMDEIENYVKKYTESNRIMYLQFKYIYLQSLNITVSFVPPNSPFRSYYDKNLNKDINETCHSIQTLLNNLISSKIIFKMLETTKEQILLLWNNKKISQQNYNQENQEKSKMIDSENEKLEKYTNKFEHNIKPHIEDIEKKVNEYINNSDCHLTCSKYKTIINNYIDEIITTNTNIYENKYNLPQERIIKNYNHNGINNDDNFIEYNILNADPDLRSHFITLLVSRKQLIYIEYIYFINKHIVNKIQENFKLNQNKYIHFINSNNAVNAAKEYEYIIKYYTTFKYLQTLNKSLYDSIYKHKINNYSHNIEDLINQLQHKINNLMIISFDKNKSSDLMLQCTNIKKYTDDICLSIKPKALEVEYLRNINKHINKNEFLNKFMQNETFKKNIDDKIKEMNNIYDNIYIILKQKFLNKLNEIIQNHKNKQETKLNTTTIQELLQLLKDIKEIQTKQIDTKINTFNMYYNDIQQIKIKINQNEKEIKKVLPQLYIPKNEQEYIQIYKNELKDRIKETQTKINLFKQILELKEKEHYITNKHTYLNFTHKTIQQILQQQYKNNTQEKNTLAQFLYNADIKKYIDELIPITQQIQTKMYTTNNIEHIKQILINYIQECKPIQNISEHTIYTLYQEIKTNLENIEQKIMQNIQQTTNRLKINIKKIFDQINQKYDDLTKNINQMNDEKIGLRQMENRLKGKYEEIKKANLQDRDIKYIVQNNDANNNNNNIIIINGNNQTGDYNHILFDYTHLWDNAQFTRTKENINNLKDNIQININNIKSIIRNLQNELNNYNTLKSNSIHIYDKIHTLEELKILTQEINDKNVIRKIYDIETIYQNDLHNIEEIIKNITSIYYKINILNILIICIKQTYNNNKSIESLKLKINNLTNSTQEYINQIKAIPTNLLPEHIKQKSVSELNIYMKQIYDKLNEHVINNLYTKSKDSLQFYINEKNYNNNHDDHNDDHNDVYNDIKENEIYKNNKLYECIQIKKDVDELYNIYDQLFKNISQNYNNHSLSFVHSINNHMLSIFQDTKYGKHKNQQILSDIENIIKQNEHTESYKNLDTSNIQLIKEQIKYFLQIFHILQENITTFENQYKDLIIKMNHKINNNLKDITHIVINDNNTLQEQNRIYNELQNKIKQIKNVSDVFTHNINYSQQILNYSQAQNSFFNIFMKFQNINNDINSKRYNVQKKITEIINSYDIINYNKNNIKDIYQQFKNIQQQLNTTETQLNHIKQNINHFKYFYESHQTISIVKNMQNEKLKIQEFNKKIQHFKEETQIMINKLIQPSHIHLHKMKLPITQQQLNTILHRNEQTKNATRSYNMNEEENEMGYGITNKRKNSETNDMINTTIGDKTNVLKNDDQEKGKRGTSRNNNIHTNENNINNEHTNENNINNEHTNEKNINNEHANEKNIYNEHTNENNINYEHPNNYQQKNDEKISLQHKTINTSQRTIDDSNMDRNNRYNTSSQQKNNLHTNNNSNSRYNNNHDKQNEHKYNQGKSSGKDNAYYRIFYAGGITAVLLLCSSTAFFFIKNSNEPHHIFNIFQKEFSEADNAHSEEKEEYLPVYFDEVEDEVEDEVEDEDENENEVENENEDFNDI

SEQ ID NO: 4 - DNA, 5151 bp, Plasmodium falciparum
atgaataagaatatattgtggataacttttttttattttttattttttctcttggatatgtaccaaggaaatgacgcaattccctcaaaagaaaaaaaaaacgatccagaagcagattctaagaactcacagaatcaacatgatataaataaaacacaccatacgaacaataattatgatctgaatattaaggataaagatgagaaaaaaagaaaaaatgataatttaatcaataattatgattactctcttttaaagttatcttataataagaatcaagatatatataagaatatacaaaatggccaaaagcttaaaacagacataatattaaactcatttgttcaaattaattcatcaaacatattaatggatgaaatagaaaattatgtgaaaaaatatacggaatcgaatcgtattatgtacttacaatttaaatatatatatctacaatccttaaatataacagtatcttttgtacctccgaattcaccatttcgaagttattatgacaaaaatttaaataaagatataaatgaaacttgtcattccatacaaacacttctaaacaatctaatatcttccaaaattatatttaaaatgttagaaactacaaaagaacaaatattacttttatggaataacaaaaaaattagtcaacaaaattataatcaagaaaatcaagaaaaaagtaaaatgatcgattcggaaaatgaaaaactagaaaagtacacaaacaagtttgaacataatatcaaacctcatatagaagatatagagaaaaaagtaaatgaatatattaataattccgattgtcatttaacatgttcaaaatataaaacaattatcaataattatatagatgaaataataacaactaatacaaacatatacgaaaacaaatataatctaccacaagaacgaattatcaaaaactataatcataatggtattaataatgatgataattttatagaatataatattcttaatgcagatcctgatttaagatctcattttataacacttcttgtttcaagaaaacaattaatctatattgaatatatttattttattaacaaacatattgtaaataaaattcaagaaaactttaaattaaatcaaaataaatatatacattttattaattcaaataatgctgttaatgctgctaaagaatatgaatatatcataaaatattatactacattcaaatatctacagacattaaataaatcattatacgactctatatataaacataaaataaataattattctcataacattgaagatcttataaaccaactacaacataaaattaataacctaatgattatctcattcgataaaaataaatcatcagatttaatgttacaatgtacaaatataaaaaaatataccgatgatatatgtttatccattaaacctaaagcattagaagtcgaatatttaagaaatataaataaacacatcaacaaaaatgaattcctaaataaattcatgcaaaacgaaacatttaaaaaaaatatagatgataaaatcaaagaaatgaataatatatacgataatatatatatcatattaaaacaaaaattcttaaacaaattaaacgaaatcatacaaaatcataaaaataaacaagaaacaaaattaaataccacaaccattcaagaattgttacaacttctaaaggatattaaagaaatacaaacaaaacaaatcgatacaaaaattaatacttttaatatgtattataacgatatacaacaaataaaaataaagattaatcaaaatgaaaaagaaataaaaaaggtactccctcaattatatatcccaaaaaatgaacaagaatatatacaaatatataaaaatgaattaaaggatagaataaaagaaacacaaacaaaaattaatttatttaagcaaattttagaattaaaagaaaaagaacattatattacaaacaaacatacatacctaaattttacacacaaaactattcaacaaatattacaacaacaatataaaaacaacacacaagaaaaaaatacactagcacaatttttatacaatgcagatatcaaaaaatatattgatgaattaatacctatcacacaacaaatacaaaccaaaatgtatacaacaaataatatagaacatattaaacaaatactcataaattatatacaagaatgtaaacctatacaaaatatatcagaacatactatttatacactatatcaagaaatcaaaacaaatctggaaaacatcgaacagaaaattatgcaaaatatacaacaaactacaaatcggttaaaaataaatattaaaaaaatatttgatcaaataaatcaaaaatatgacgacttaacaaaaaatataaaccaaatgaatgatgaaaaaattgggttacgacaaatggaaaataggttgaaagggaaatatgaagaaataaaaaaggcaaatcttcaagatagggacataaaatatatagtccaaaataatgatgctaataataataataataatattattattattaatggtaataatcaaaccggtgattataatcacatcttgttcgattatactcacctttgggataatgcacaatttactagaacaaaagaaaatataaacaacctaaaagataatatacaaatcaacataaataatatcaaaagtataataagaaatttacaaaacgaactaaacaattataatactcttaaaagcaattccatccatatttatgataaaatacacacattagaagaattaaaaatattaactcaagaaattaatgataaaaatgttatcagaaaaatatatgatattgaaaccatatatcaaaatgatttacataacatagaagaaattattaaaaatattacaagcatttattacaaaataaatatcttaaatatattaattatttgcatcaaacaaacatataataataataaatccattgaaagcttaaaacttaaaattaataacttaacaaattcaacacaagaatatattaatcaaataaaagctatcccaactaatttattaccagaacatataaaacaaaaaagtgtaagcgaactaaatatttatatgaaacaaatatatgataaattaaatgaacatgttattaataatttatatacaaaatcaaaggattcattacaattttatattaacgaaaaaaattataataataatcatgatgatcataatgatgaccataatgatgtatataatgatatcaaagaaaatgaaatatataaaaataataaattatacgaatgcatacaaatcaaaaaggatgtagacgaattatataatatttatgatcaactctttaaaaatatatcccaaaattataataaccactcccttagttttgtacattcaataaataatcatatgctatctatttttcaagatactaaatatggaaaacacaaaaatcaacaaatcctatccgatatagaaaatattataaaacaaaatgaacacacagaatcatataaaaatttagacacaagtaatatacaactaataaaagaacaaattaaatatttcttacaaatatttcatatacttcaagaaaatataaccactttcgaaaatcaatataaagatttaattatcaaaatgaaccataaaattaataataatctaaaagatattacacatattgtcataaacgataacaatacattacaagaacaaaatcgtatttataacgaacttcaaaacaaaattaaacaaataaaaaatgtcagtgatgtattcacacataatattaattacagtcaacaaatattaaattattctcaagcacaaaatagtttttttaatatatttatgaaatttcaaaacattaataatgatattaatagcaaacgatataatgtacaaaaaaaaattacagagataatcaattcatatgatataataaattataacaaaaataatatcaaagatatttatcaacaattcaaaaatatacaacaacaattaaatacaacagaaacgcaattgaatcatataaaacaaaatattaatcatttcaaatatttttatgaatctcatcaaaccatatctatagtaaagaatatgcaaaatgaaaaactaaaaattcaagaattcaacaaaaaaatacaacacttcaaggaagaaacacaaattatgataaacaagttaatacaacctagccacatacatttacataaaatgaaattgcctataactcaacagcaacttaatacaattcttcatagaaatgaacaaacaaaaaatgctacaagaagttacaatatgaatgaggaggaaaatgaaatgggatatggcataactaataaaaggaaaaatagtgagacaaatgacatgataaataccaccataggagacaagacaaatgtcttaaaaaatgatgatcaagaaaaaggtaaaaggggaacttccagaaataataatattcatacaaatgaaaataatataaataatgaacatacaaatgaaaataatataaataatgaacatacaaatgaaaagaatataaataatgaacatgcaaatgaaaagaatatatataatgaacatacaaatgaaaataatataaattatgaacatccaaataattatcaacaaaaaaatgatgaaaaaatatcactacaacataaaacaattaatacatcacaacgtaccatagatgattcgaatatggatcgaaataatagatataacacatcatcacaacaaaaaaataatttgcatacaaataataatagtaatagtagatacaacaataaccatgataaacaaaatgaacataaatataatcaaggaaaatcttcagggaaagataacgcatattatagaattttttatgctggaggaattacagctgtcttacttttatgttcaagtactgcattcttttttataaaaaactctaatgaaccacatcatatttttaatatttttcaaaaggaatttagtgaagcagataatgcacattcagaagaaaaagaagaatatctacctgtctattttgatgaagttgaagatgaagttgaagatgaagttgaagatgaagatgaaaatgaaaatgaagttgaaaatgaaaatgaagattttaatgacatatga

SEQ ID NO: 5 - protein, 1462 aa, Plasmodium falciparum
MKCNISIYFFASFFVLYFAKARNEYDIKENEKFLDVYKEKFNELDKKKYGNVQKTDKKIFTFIENKLDILNNSKFNKRWKSYGTPDNIDKNMSLINKHNNEEMFNNNYQSFLSTSSLIKQNKYVPINAVRVSRILSFLDSRINNGRNTSSNNEVLSNCREKRKGMKWDCKKKNDRSNYVCIPDRRIQLCIVNLSIIKTYTKETMKDHFIEASKKESQLLLKKNDNKYNSKFCNDLKNSFLDYGHLAMGNDMDFGGYSTKAENKIQEVFKGAHGEISEHKIKNFRKKWWNEFREKLWEAMLSEHKNNINNCKNIPQEELQITQWIKEWHGEFLLERDNRSKLPKSKCKNNTLYEACEKECIDPCMKYRDWIIRSKFEWHTLSKEYETQKVPKENAENYLIKISENKNDAKVSLLLNNCDAEYSKYCDCKHTTTLVKSVLNGNDNTIKEKREHIDLDDFSKFGCDKNSVDTNTKVWECKKPYKLSTKDVCVPPRRQELCLGNIDRIYDKNLLMIKEHILAIAIYESRILKRKYKNKDDKEVCKIINKTFADIRDIIGGTDYWNDLSNRKLVGKINTNSNYVHRNKQNDKLFRDEWWKVIKKDVWNVISWVFKDKTVCKEDDIENIPQFFRWFSEWGDDYCQDKTKMIETLKVECKEKPCEDDNCKRKCNSYKEWISKKKEEYNKQAKQYQEYQKGNNYKMYSEFKSIKPEVYLKKYSEKCSNLNFEDEFKEELHSDYKNKCTMCPEVKDVPISIIRNNEQTSQEAVPEESTEIAHRTETRTDERKNQEPANKDLKNPQQSVGENGTKDLLQEDLGGSRSEDEVTQEFGVNHGIPKGEDQTLGKSDAIPNIGEPETGISTTEESRHEEGHNKQALSTSVDEPELSDTLQLHEDTKENDKLPLESSTITSPTESGSSDTEETPSISEGPKGNEQKKRDDDSLSKISVSPENSRPETDAKDTSNLLKLKGDVDISMPKAVIGSSPNDNINVTEQGDNISGVNSKPLSDDVRPDKNHEEVKEHTSNSDNVQQSGGIVNMNVEKELKDTLENPSSSLDEGKAHEELSEPNLSSDQDMSNTPGPLDNTSEETTERISNNEYKVNEREGERTLTKEYEDIVLKSHMNRESDDGELYDENSDLSTVNDESEDAEAKMKGNDTSEMSHNSSQHIESDQQKNDMKTVGDLGTTHVQNEISVPVTGEIDEKLRESKESKIHKAEEERLSHTDIHKINPEDRNSNTLHLKDIRNEENERHLTNQNINISQERDLQKHGFHTMNNLHGDGVSERSQINHSHHGNRQDRGGNSGNVLNMRSNNNNFNNIPSRYNLYDKKLDLDLYENRNDSTTKELIKKLAEINKCENEISVKYCDHMIHEEIPLKTCTKEKTRNLCCAVSDYCMSYFTYDSEEYYNCTKREFDDPSYTCFRKEAFSSMPYYAGAGVLFIILVILGASQAKYQRLEKINKNKIEKNVN

SEQ ID NO: 6 - DNA, 4389 bp, Plasmodium falciparum
atgaaatgtaatattagtatatatttttttgcttccttctttgtgttatattttgcaaaagctaggaatgaatatgatataaaagagaatgaaaaatttttagacgtgtataaagaaaaatttaatgaattagataaaaagaaatatggaaatgttcaaaaaactgataagaaaatatttacttttatagaaaataaattagatattttaaataattcaaaatttaataaaagatggaagagttatggaactccagataatatagataaaaatatgtctttaataaataaacataataatgaagaaatgtttaacaacaattatcaatcatttttatcgacaagttcattaataaagcaaaataaatatgttcctattaacgctgtacgtgtgtctaggatattaagtttcctggattctagaattaataatggaagaaatacttcatctaataacgaagttttaagtaattgtagggaaaaaaggaaaggaatgaaatgggattgtaaaaagaaaaatgatagaagcaactatgtatgtattcctgatcgtagaatccaattatgcattgttaatcttagcattattaaaacatatacaaaagagaccatgaaggatcatttcattgaagcctctaaaaaagaatctcaacttttgcttaaaaaaaatgataacaaatataattctaaattttgtaatgatttgaagaatagttttttagattatggacatcttgctatgggaaatgatatggattttggaggttattcaactaaggcagaaaacaaaattcaagaagtttttaaaggggctcatggggaaataagtgaacataaaattaaaaattttagaaaaaaatggtggaatgaatttagagagaaactttgggaagctatgttatctgagcataaaaataatataaataattgtaaaaatattccccaagaagaattacaaattactcaatggataaaagaatggcatggagaatttttgcttgaaagagataatagatcaaaattgccaaaaagtaaatgtaaaaataatacattatatgaagcatgtgagaaggaatgtattgatccatgtatgaaatatagagattggattattagaagtaaatttgaatggcatacgttatcgaaagaatatgaaactcaaaaagttccaaaggaaaatgcggaaaattatttaatcaaaatttcagaaaacaagaatgatgctaaagtaagtttattattgaataattgtgatgctgaatattcaaaatattgtgattgtaaacatactactactctcgttaaaagcgttttaaatggtaacgacaatacaattaaggaaaagcgtgaacatattgatttagatgatttttctaaatttggatgtgataaaaattccgttgatacaaacacaaaggtgtgggaatgtaaaaaaccttataaattatccactaaagatgtatgtgtacctccgaggaggcaagaattatgtcttggaaacattgatagaatatacgataaaaacctattaatgataaaagagcatattcttgctattgcaatatatgaatcaagaatattgaaacgaaaatataagaataaagatgataaagaagtttgtaaaatcataaataaaactttcgctgatataagagatattataggaggtactgattattggaatgatttgagcaatagaaaattagtaggaaaaattaacacaaattcaaattatgttcacaggaataaacaaaatgataagctttttcgtgatgagtggtggaaagttattaaaaaagatgtatggaatgtgatatcatgggtattcaaggataaaactgtttgtaaagaagatgatattgaaaatataccacaattcttcagatggtttagtgaatggggtgatgattattgccaggataaaacaaaaatgatagagactctgaaggttgaatgcaaagaaaaaccttgtgaagatgacaattgtaaacgtaaatgtaattcatataaagaatggatatcaaaaaaaaaagaagagtataataaacaagccaaacaataccaagaatatcaaaaaggaaataattacaaaatgtattctgaatttaaatctataaaaccagaagtttatttaaagaaatactcggaaaaatgttctaacctaaatttcgaagatgaatttaaggaagaattacattcagattataaaaataaatgtacgatgtgtccagaagtaaaggatgtaccaatttctataataagaaataatgaacaaacttcgcaagaagcagttcctgaggaaagcactgaaatagcacacagaacggaaactcgtacggatgaacgaaaaaatcaggaaccagcaaataaggatttaaagaatccacaacaaagtgtaggagagaacggaactaaagatttattacaagaagatttaggaggatcacgaagtgaagacgaagtgacacaagaatttggagtaaatcatggaatacctaagggtgaggatcaaacgttaggaaaatctgacgccattccaaacataggcgaacccgaaacgggaatttccactacagaagaaagtagacatgaagaaggccacaataaacaagcattgtctacttcagtcgatgagcctgaattatctgatacacttcaattgcatgaagatactaaagaaaatgataaactacccctagaatcatctacaatcacatctcctacggaaagtggaagttctgatacagaggaaactccatctatctctgaaggaccaaaaggaaatgaacaaaaaaaacgtgatgacgatagtttgagtaaaataagtgtatcaccagaaaattcaagacctgaaactgatgctaaagatacttctaacttgttaaaattaaaaggagatgttgatattagtatgcctaaagcagttattgggagcagtcctaatgataatataaatgttactgaacaaggggataatatttccggggtgaattctaaacctttatctgatgatgtacgtccagataaaaatcatgaagaggtgaaagaacatactagtaattctgataatgttcaacagtctggaggaattgttaatatgaatgttgagaaagaactaaaagatactttagaaaatccttctagtagcttggatgaaggaaaagcacatgaagaattatcagaaccaaatctaagcagtgaccaagatatgtctaatacacctggacctttggataacaccagtgaagaaactacagaaagaattagtaataatgaatataaagttaacgagagggaaggtgagagaacgcttactaaggaatatgaagatattgttttgaaaagtcatatgaatagagaatcagacgatggtgaattatatgacgaaaattcagacttatctactgtaaatgatgaatcagaagacgctgaagcaaaaatgaaaggaaatgatacatctgaaatgtcgcataatagtagtcaacatattgagagtgatcaacagaaaaacgatatgaaaactgttggtgatttgggaaccacacatgtacaaaacgaaattagtgttcctgttacaggagaaattgatgaaaaattaagggaaagtaaagaatcaaaaattcataaggctgaagaggaaagattaagtcatacagatatacataaaattaatcctgaagatagaaatagtaatacattacatttaaaagatataagaaatgaggaaaacgaaagacacttaactaatcaaaacattaatattagtcaagaaagggatttgcaaaaacatggattccataccatgaataatctacatggagatggagtttccgaaagaagtcaaattaatcatagtcatcatggaaacagacaagatcgggggggaaattctgggaatgttttaaatatgagatctaataataataattttaataatattccaagtagatataatttatatgataaaaaattagatttagatctttatgaaaacagaaatgatagtacaacaaaagaattaataaagaaattagcagaaataaataaatgtgagaacgaaatttctgtaaaatattgtgaccatatgattcatgaagaaatcccattaaaaacatgcactaaagaaaaaacaagaaatctgtgttgtgcagtatcagattactgtatgagctattttacatatgattcagaggaatattataattgtacgaaaagggaatttgatgatccatcttatacatgtttcagaaaggaggctttttcaagtatgccatattatgcaggagcaggtgtgttatttattatattggttattttaggtgcttcacaagccaaatatcaaaggttagaaaaaataaataaaaataaaattgagaagaatgtaaattaa

SEQ ID NO: 7 - protein, 1567 aa, Plasmodium falciparum
MKGKMNMCLFFFYSILYVVLCTYVLGISEEYLKERPQGLNVETNNNNNNNNNNNSNSNDAMSFVNEVIRFIENEKDDKEDKKVKIISRPVENTLHRYPVSSFLNIKKYGRKGEYLNRNSFVQRSYIRGCKGKRSTHTWICENKGNNNICIPDRRVQLCITALQDLKNSGSETTDRKLLRDKVFDSAMYETDLLWNKYGFRGFDDFCDDVKNSYLDYKDVIFGTDLDKNNISKLVEESLKRFFKKDSSVLNPTAWWRRYGTRLWKTMIQPYAHLGCRKPDENEPQINRWILEWGKYNCRLMKEKEKLLTGECSVNRKKSDCSTGCNNECYTYRSLINRQRYEVSILGKKYIKVVRYTIFRRKIVQPDNALDFLKLNCSECKDIDFKPFFEFEYGKYEEKCMCQSYIDLKIQFKNNDICSFNAQTDTVSSDKRFCLEKKEFKPWKCDKNSFETVHHKGVCVSPRRQGFCLGNLNYLLNDDIYNVHNSQLLIEIIMASKQEGKLLWKKHGTILDNQNACKYINDSYVDYKDIVIGNDLWNDNNSIKVQNNLNLIFERNFGYKVGRNKLFKTIKELKNVWWILNRNKVWESMRCGIDEVDQRRKTCERIDELENMPQFFRWFSQWAHFFCKEKEYWELKLNDKCTGNNGKSLCQDKTCQNVCTNMNYWTYTRKLAYEIQSVKYDKDRKLFSLAKDKNVTTFLKENAKNCSNIDFTKIFDQLDKLFKERCSCMDTQVLEVKNKEMLSIDSNSEDATDISEKNGEEELYVNHNSVSVASGNKEIEKSKDEKQPEKEAKQTNGTLTVRTDKDSDRNKGKDTATDTKNSPENLKVQEHGTNGETIKEEPPKLPESSETLQSQEQLEAEAQKQKQEEEPKKKQEEEPKKKQEEEQKREQEQKQEQEEEEQKQEEEQQIQDQSQSGLDQSSKVGVASEQNEISSGQEQNVKSSSPEVVPQETTSENGSSQDTKISSTEPNENSVVDRATDSMNLDPEKVHNENMSDPNTNTEPDASLKDDKKEVDDAKKELQSTVSRIESNEQDVQSTPPEDTPTVEGKVGDKAEMLTSPHATDNSESESGLNPTDDIKTTDGVVKEQEILGGGESATETSKSNLEKPKDVEPSHEISEPVLSGTTGKEESELLKSKSIETKGETDPRSNDQEDATDDVVENSRDDNNSLSNSVDNQSNVLNREDPIASETEVVSEPEDSSRIITTEVPSTTVKPPDEKRSEEVGEKEAKEIKVEPVVPRAIGEPMENSVSVQSPPNVEDVEKETLISENNGLHNDTHRGNISEKDLIDIHLLRNEAGSTILDDSRRNGEMTEGSESDVGELQEHNFSTQQKDEKDFDQIASDREKEEIQKLLNIGHEEDEDVLKMDRTEDSMSDGVNSHLYYNNLSSEEKMEQYNNRDASKDREEILNRSNTNTCSNEHSLKYCQYMERNKDLLETCSEDKRLHLCCEISDYCLKFFNPKSIEYFDCTQKEFDDPTYNCFRKQRFTSMHYIAGGGIIALLLFILGSASYRKNLDDEKGFYDSNLNDSAFEYNNNKYNKLPYMFDQQINVVNSDLYSEGIYDDTTTF

SEQ ID NO: 8 - DNA, 4704 bp, Plasmodium falciparum
atgaaagggaaaatgaatatgtgtttgttttttttctattctatattatatgttgtattatgtacctatgtattaggtataagtgaagagtatttgaaggaaaggccccaaggtttaaatgttgagactaataataataataataataataataataataatagtaatagtaacgatgcgatgtcttttgtaaatgaagtaataaggtttatagaaaacgagaaggatgataaagaagataaaaaagtgaagataatatctagacctgttgagaatacattacatagatatccagttagttcttttctgaatatcaaaaagtatggtaggaaaggggaatatttgaatagaaatagttttgttcaaagatcatatataaggggttgtaaaggaaaaagaagcacacatacatggatatgtgaaaataaagggaataataatatatgtattcctgatagacgtgtacaattatgtataacagctcttcaagatttaaaaaattcaggatctgaaacgactgatagaaaattattaagagataaagtatttgattcagctatgtatgaaactgatttgttatggaataaatatggttttcgtggatttgatgatttttgtgacgatgtaaaaaatagttatttagattataaagatgttatatttggaaccgatttagataaaaataatatatcaaagttagtagaggaatcattaaaacgtttttttaaaaaagatagtagtgtacttaatcctactgcttggtggagaaggtatggaacaagactatggaaaactatgatacagccatatgctcatttaggatgtagaaaacctgatgagaatgaacctcagataaatagatggattctggaatgggggaaatataattgtagattaatgaaggagaaagaaaaattgttaacaggagaatgttctgttaatagaaaaaaatctgactgctcaaccggatgtaataatgagtgttatacctataggagtcttattaatagacaaagatatgaggtctctatattaggaaaaaaatatattaaagtagtacgatatactatatttaggagaaaaatagttcaacctgataatgctttggattttttaaaattaaattgttctgagtgtaaggatattgattttaaacccttttttgaatttgaatatggtaaatatgaagaaaaatgtatgtgtcaatcatatattgatttaaaaatccaatttaaaaataatgatatttgttcatttaatgctcaaacagatactgtttctagcgataaaagattttgtcttgaaaagaaagaatttaaaccatggaaatgtgataaaaattcttttgaaacagttcatcataaaggtgtatgtgtgtcaccgagaagacaaggtttttgtttaggaaatttgaactatctactgaatgatgatatttataatgtacataattcacaactacttatcgaaattataatggcttctaaacaagaaggaaagttattatggaaaaaacatggaacaatacttgataaccagaatgcatgcaaatatataaatgatagttatgttgattataaagatatagttattggaaatgatttatggaatgataacaactctataaaagttcaaaataatttaaatttaatttttgaaagaaattttggttataaagttggaagaaataaactctttaaaacaattaaagaattaaaaaatgtatggtggatattaaatagaaataaagtatgggaatcaatgagatgtggaattgacgaagtagatcaacgtagaaaaacttgtgaaagaatagatgaactagaaaacatgccacaattctttagatggttttcacaatgggcacatttcttttgtaaggaaaaagaatattgggaattaaaattaaatgataaatgtacaggtaataatggaaaatccttatgtcaggataaaacatgtcaaaatgtgtgtactaatatgaattattggacatatactagaaaattagcttatgaaatacaatccgtaaaatatgataaagatagaaaattatttagtcttgctaaagacaaaaatgtaactacatttttaaaggaaaatgcaaaaaattgttctaatatagattttacaaaaatattcgatcagcttgacaaactctttaaggaaagatgttcatgtatggatacacaagttttagaagtaaaaaacaaagaaatgttatctatagactcaaatagtgaagatgcgacagatataagtgagaaaaatggagaggaagaattatatgtaaatcacaattctgtgagtgtcgcaagtggtaataaagaaatcgaaaagagtaaggatgaaaagcaacctgaaaaagaagcaaaacaaactaatggaactttaaccgtacgaactgacaaagattcagatagaaacaaaggaaaagatacagctactgatacaaaaaattcacctgaaaatttaaaagtacaggaacatggaacaaatggagaaacaataaaagaagaaccaccaaaattacctgaatcatctgaaacattacaatcacaagaacaattagaagcagaagcacaaaaacaaaaacaagaagaagaaccaaaaaaaaaacaagaagaagaaccaaaaaaaaaacaagaagaagaacaaaaacgagaacaagaacaaaaacaagaacaagaagaagaagaacaaaaacaagaagaagaacaacaaatacaagatcaatcacaaagtggattagatcaatcctcaaaagtaggagtagcgagtgaacaaaatgaaatttcttcaggacaagaacaaaacgtaaaaagctcttcacctgaagtagttccacaagaaacaactagtgaaaatgggtcatcacaagacacaaaaatatcaagtactgaaccaaatgagaattctgttgtagatagagcaacagatagtatgaatttagatcctgaaaaggttcataatgaaaatatgagtgatccaaatacaaatactgaaccagatgcatctttaaaagatgataagaaggaagttgatgatgccaaaaaagaacttcaatctactgtatcaagaattgaatctaatgaacaggacgttcaaagtacaccacccgaagatactcctactgttgaaggaaaagtaggagataaagcagaaatgttaacttctccgcatgcgacagataattctgagtcggaatcaggtttaaatccaactgatgacattaaaacaactgatggtgttgttaaagaacaagaaatattagggggaggtgaaagtgcaactgaaacatcaaaaagtaatttagaaaaacctaaggatgttgaaccttctcatgaaatatctgaacctgttctttctggtacaactggtaaagaagaatcagagttattaaaaagtaaatcgatagagacgaagggggaaacagatcctcgaagtaatgaccaagaagatgctactgacgatgttgtagaaaatagtagagatgataataatagtctctctaatagcgtagataatcaaagtaatgttttaaatagagaagatcctattgcttctgaaactgaagttgtaagtgaacctgaggattcaagtaggataatcactacagaagttccaagtactactgtaaaaccccctgatgaaaaacgatctgaagaagtaggagaaaaagaagctaaagaaattaaagtagaacctgttgtaccaagagccattggagaaccaatggaaaattctgtgagcgtacagtcccctcctaatgtagaagatgttgaaaaagaaacattgatatctgagaataatggattacataatgatacacacagaggaaatatcagtgaaaaggatttaatcgatattcatttgttaagaaatgaagcgggtagtacaatattagatgattctagaagaaatggagaaatgacagaaggtagcgaaagtgatgttggagaattacaagaacataattttagcacacaacaaaaagatgaaaaagattttgaccaaattgcgagcgatagagaaaaagaagaaattcaaaaattacttaatataggacatgaagaggatgaagatgtattaaaaatggatagaacagaggatagtatgagtgatggagttaatagtcatttgtattataataatctatcaagtgaagaaaaaatggaacaatataataatagagatgcttctaaagatagagaagaaatattgaataggtcaaacacaaatacatgttctaatgaacattcattaaaatattgtcaatatatggaaagaaataaggatttattagaaacatgttctgaagacaaaaggttacatttatgttgtgaaatatcagattattgtttaaaatttttcaatcctaaatcgatagaatactttgattgtacacaaaaagaatttgatgaccctacatataattgttttagaaaacaaagatttacaagtatgcattatattgccgggggtggtataatagcccttttattgtttattttaggttcagccagctataggaagaatttggatgatgaaaaaggattctacgattctaatttaaatgattctgcttttgaatataataataataaatataataaattaccttatatgtttgatcaacaaataaatgtagtaaattctgatttatattcggagggtatttatgatgacacaacgacattttaa

SEQ ID NO: 9 - protein, 1210 aa, Plasmodium falciparum
MKGYFNIYFLIPLIFLYNVIRINESIIGRTLYNRQDESSDISRVNSPELNNNHKTNIYDSDYEDVNNKLINSFVENKSVKKKRSLSFINNKTKSYDIIPPSYSYRNDKFNSLSENEDNSGNTNSNNFANTSEISIGKDNKQYTFIQKRTHLFACGIKRKSIKWICRENSEKITVCVPDRKIQLCIANFLNSRLETMEKFKEIFLISVNTEAKLLYNKNEGKDPSIFCNELRNSFSDFRNSFIGDDMDFGGNTDRVKGYINKKFSDYYKEKNVEKLNNIKKEWWEKNKANLWNHMIVNHKGNISKECAIIPAEEPQINLWIKEWNENFLMEKKRLFLNIKDKCVENKKYEACFGGCRLPCSSYTSFMKKSKTQMEVLTNLYKKKNSGVDKNNFLNDLFKKNNKNDLDDFFKNEKEYDDLCDCRYTATIIKSFLNGPAKNDVDIASQINVNDLRGFGCNYKSNNEKSWNCTGTFTNKFPGTCEPPRRQTLCLGRTYLLHRGHEEDYKEHLLGASIYEAQLLKYKYKEKDENALCSIIQNSYADLADIIKGSDIIKDYYGKKMEENLNKVNKDKKRNEESLKIFREKWWDENKENVWKVMSAVLKNKETCKDYDKFQKIPQFLRWFKEWGDDFCEKRKEKIYSFESFKVECKKKDCDENTCKNKCSEYKKWIDLKKSEYEKQVDKYTKDKNKKMYDNIDEVKNKEANVYLKEKSKECKDVNFDDKIFNESPNEYEDMCKKCDEIKYLNEIKYPKTKHDIYDIDTFSDTFGDGTPISINANINEQQSGKDTSNTGNSETSDSPVSHEPESDAAINVEKLSGDESSSETRGILDINDPSVTNNVNEVHDASNTQGSVSNTSDITNGHSESSLNRTTNAQDIKIGRSGNEQSDNQENSSHSSDNSGSLTIGQVPSEDNTQNTYDSQNPHRDTPNALASLPSDDKINEIEGFDSSRDSENGRGDTTSNTHDVRRTNIVSERRVNSHDFIRNGMANNNAHHQYITQIENNGIIRGQEESAGNSVNYKDNPKRSNFSSENDHKKNIQEYNSRDTKRVREEIIKLSKQNKCNNEYSMEYCTYSDERNSSPGPCSREERKKLCCQISDYCLKYFNFYSIEYYNCIKSEIKSPEYKCFKSEGQSSIPYFAAGGILVVIVLLLSSASRMGKSNEEYDIGESNIEATFEENNYLNKLSRIFNQEVQETNISDYSEYNYNEKNMY

SEQ ID NO: 10 - DNA, 3633 bp, Plasmodium falciparum
atgaaaggatattttaatatatattttttaattcctttaatttttttatataatgtaataagaataaatgaatcaattataggtagaacactttataatagacaagatgaatcatcagatatttcaagggtaaattcacccgaattaaataataatcataaaactaatatatatgattcagattacgaagatgtaaataataaattaataaacagttttgtagaaaataaaagtgtgaaaaaaaaaaggtctttaagttttataaataataaaacaaaatcatatgatataattccaccttcatattcatataggaatgataaatttaattcactttccgaaaatgaagataattctggaaatacaaatagtaataatttcgcaaatacttctgaaatatctattggaaaggataataaacaatatacgtttatacagaaacgtactcatttgtttgcttgtggaataaaaagaaaatcaataaaatggatatgtcgagaaaacagtgagaaaattactgtatgtgttcctgatagaaaaatacaactatgtattgcaaattttttaaactcacgtttagaaacaatggaaaagtttaaagaaatatttttaatttctgttaatacagaagcaaaattattatataacaaaaatgaaggaaaagatccctcaatattttgtaatgaattaagaaatagtttttcagattttagaaattcatttataggtgatgatatggattttggtggtaatacagatagagtcaaaggatatattaataagaagttctccgattattataaggaaaaaaatgttgaaaaattaaataatatcaaaaaagaatggtgggaaaaaaataaagcaaatttgtggaatcacatgatagtaaatcataaaggaaacataagtaaagaatgtgccataattcccgcggaagaacctcaaattaatctatggataaaagaatggaatgaaaacttcttgatggaaaagaagagattgtttttaaatataaaagataagtgtgttgaaaacaaaaaatatgaagcatgttttggtggatgtaggcttccatgttcttcatatacatcatttatgaaaaaaagtaaaacacaaatggaggttttgacgaacttgtataaaaagaaaaattcaggagtggataaaaataattttctgaatgatctttttaaaaaaaataataaaaatgatttagatgattttttcaaaaatgaaaaggaatatgatgatttatgtgattgcagatatactgctactattattaaaagttttctaaatggtcctgctaaaaatgatgtagatattgcatcacaaattaatgttaatgatcttcgagggtttggatgtaattataaaagtaataatgaaaaaagttggaattgtactggaacatttacgaacaaatttcctggtacatgtgaaccccccagaagacaaactttatgtcttggacgtacatatcttttacatcgtggtcatgaggaagattataaggaacatttacttggagcttcaatatatgaggcgcaattattaaaatataaatataaggaaaaggatgaaaatgcattgtgtagtataatacaaaatagttatgcagatttggcagatattatcaagggatcggatataataaaagattattatggtaaaaaaatggaagaaaatttaaataaagtaaacaaagataaaaaacgtaatgaagaatctttgaagatttttcgtgaaaaatggtgggatgaaaacaaggagaatgtatggaaagtaatgtcagcagtacttaaaaataaggaaacgtgtaaagattatgataagtttcaaaagattcctcaatttttaagatggtttaaggaatggggagacgatttttgtgagaaaagaaaagagaaaatatattcatttgagtcatttaaggtagaatgtaagaaaaaagattgtgatgaaaatacatgtaaaaataaatgtagtgaatataaaaaatggatagatttgaaaaaaagtgaatatgagaaacaagttgataaatacacaaaagataaaaataaaaagatgtatgataatattgatgaagtaaaaaataaagaagccaatgtttacttaaaagaaaaatccaaagaatgtaaagatgtaaatttcgatgataaaatttttaatgagagtccaaatgaatatgaagatatgtgtaaaaaatgtgatgaaataaaatatttaaatgaaattaaatatcctaaaacaaaacacgatatatatgatatagatacattttcagatacttttggtgatggaacgccaataagtattaatgcaaatataaatgaacaacaaagtgggaaggatacctcaaatactggaaatagtgaaacatcagattcaccggttagtcatgaaccagaaagtgatgctgcaattaatgtagaaaagttaagtggtgatgaaagttcaagtgaaacaagaggaatattagatattaatgatccaagtgttacgaacaatgtcaatgaagttcatgatgcttcaaatacacaaggtagtgtttcaaatacttctgatataacgaatggacattcggaaagttccctgaatagaacaacgaatgcacaagatattaaaataggccgttcaggaaatgaacaaagtgataatcaagaaaatagttcacattctagtgataattcaggttctttgacaatcggacaagttccttcagaggataatacccaaaatacatatgattcacaaaaccctcatagagatacacctaatgcattagcatctttaccatcagatgataaaattaatgaaatagagggtttcgattctagtagagatagtgaaaatggtaggggtgatacaacatcaaatactcatgatgtacgtcgtacgaatatagtaagtgagagacgtgtgaatagccatgattttattagaaacggaatggcgaataacaatgcacatcatcaatatataacgcaaattgagaataatggaatcataagaggacaagaggaaagtgcggggaatagtgttaattataaagataatccaaagaggagtaatttttcctccgaaaatgatcataagaaaaatatacaggaatataattctagagatactaaaagagtaagggaggaaataattaaattatcgaagcaaaataaatgcaacaatgaatattccatggaatattgtacctattctgacgaaaggaatagttcaccgggtccttgttctagagaagaaagaaagaaattatgttgtcagatttcagattattgtttaaaatattttaacttttattcaattgaatattataattgtataaaatctgaaattaaaagtccagaatataaatgttttaaaagcgagggtcaatcaagcattccttattttgctgctggaggtattttagttgtaatagtcttacttttgagttcagcatctagaatggggaaaagtaatgaagaatatgatataggagaatctaatatagaagcaacttttgaagaaaataattatttaaataaactatcgcgcatatttaatcaagaagtacaagagacaaacatttcagattattccgagtacaattataatgaaaagaatatgtattaa

SEQ ID NO: 11 - protein, 3130 aa, Plasmodium falciparum
MKTTLFCSISFCNIIFFFLELSHEHFVGQSSNTHGASSVTDFNFSEEKNLKSFEGKNNNNDNYASINRLYRKKPYMKRSLINLENDLFRLEPISYIQRYYKKNINRSDIFHNKKERGSKVYSNVSSFHSFIQEGKEEVEVFSIWGSNSVLDHIDVLRDNGTVVFSVQPYYLDIYTCKEAILFTTSFYKDLDKSSITKINEDIEKFNEEIIKNEEQCLVGGKTDFDNLLIVLENAEKANVRKTLFDNTFNDYKNKKSSFYNCLKNKKNDYDKKIKNIKNEITKLLKNIESTGNMCKTESYVMNNNLYLLRVNEVKSTPIDLYLNRAKELLESSSKLVNPIKMKLGDNKNMYSIGYIHDEIKDIIKRYNFHLKHIEKGKEYIKRITQANNIADKMKKDELIKKIFESSKHFASFKYSNEMISKLDSLFIKNEEILNNLFNNIFNIFKKKYETYVDMKTIESKYTTVMTLSEHLLEYAMDVLKANPQKPIDPKANLDSEVVKLQIKINEKSNELDNAISQVKTLIIIMKSFYDIIISEKASMDEMEKKELSLNNYIEKTDYILQTYNIFKSKSNIINNNSKNISSKYITIEGLKNDIDELNSLISYFKDSQETLIKDDELKKNMKTDYLNNVKYIEENVTHINEIILLKDSITQRIADIDELNSLNLININDFINEKNISQEKVSYNLNKLYKGSFEELESELSHFLDTKYLFHEKKSVNELQTILNTSNNECAKLNFMKSDNNNNNNNSNIINLLKTELSHLLSLKENIIKKLLNHIEQNIQNSSNKYTITYTDINNRMEDYKEEIESLEVYKHTIGNIQKEYILHLYENDKNALAVHNTSMQILQYKDAIQNIKNKISDDIKILKKYKEMNQDLLNYYEILDKKLKDNTYIKEMHTASLVQITQYIPYEDKTISELEQEFNNNNQKLDNILQDINAMNLNINILQTLNIGINACNTNNKNVEHLLNKKIELKNILNDQMKIIKNDDIIQDNEKENFSNVLKKEEEKLEKELDDIKFNNLKMDIHKLLNSYDHTKQNIESNLKINLDSFEKEKDSWVHFKSTIDSLYVEYNICNQKTHNTIKQQKNDIIELIYKRIKDINQEIIEKVDNYYSLSDKALTKLKSIHFNIDKEKYKNPKSQENIKLLEDRVMILEKKIKEDKDALIQIKNLSHDHFVNADNEKKKQKEKEEDDEQTHYSKKRKVMGDIYKDIKKNLDELNNKNLIDITLNEANKIESEYEKILIDDICEQITNEAKKSDTIKEKIESYKKDIDYVDVDVSKTRNDHHLNGDKIHDSFFYEDTLNYKAYFDKLKDLYENINKLTNESNGLKSDAHNNNTQVDKLKEINLQVFSNLGNIIKYVEKLENTLHELKDMYEFLETIDINKILKSIHNSMKKSEEYSNETKKIFEQSVNITNQFIEDVEILKTSINPNYESLNDDQIDDNIKSLVLKKEEISEKRKQVNKYITDIESNKEQSDLHLRYASRSIYVIDLFIKHEIINPSDGKNFDIIKVKEMINKTKQVSNEAMEYANKMDEKNKDIIKIENELYNLINNNIRSLKGVKYEKVRKQARNAIDDINNIHSNIKTILTKSKERLDEIKKQPNIKREGDVLNNDKTKIAYITIQINNGRIESNLLNILNMKHNIDTILNKAMDYMNDVSKSDQIVINIDSLNMNDIYNKDKDLLINILKEKQNMEAEYKKMNEMYNYVNETEKEIIKHKKNYEIRIMEHIKKETNEKKKKFMESNNKSLTTLMDSFRSMFYNEYINDYNINENFEKHQNILNEIYNGFNESYNIINTKMTEIINDNLDYNEIKEIKEVAQTEYDKLNKKVDELKNYLNNIKEQEGHRLIDYIKEKIFNLYIKCSEQQNIIDDSYNYITVKKQYIKTIEDVKFLLDSLNTIEEKNKSVANLEICTNKEDIKNLLKHVIKLANFSGIIVMSDTNTEITPENPLEDNDLLNLQLYFERKHEITSTLENDSDLELDHLGSNSDESIDNLKVYNDIIELHTYSTQILKYLDNIQKLKGDCNDLVKDCKELRELSTALYDLKIQITSVINRENDISNNIDIVSNKLNEIDAIQYNFEKYKEIFDNVEEYKTLDDTKNAYIVKKAEILKNVDINKTKEDLDIYFNDLDELEKSLTLSSNEMEIKTIVQNSYNSFSDINKNINDIDKEMKTLIPMLDELLNEGHNIDISLYNFIIRNIQIKIGNDIKNIREQENDTNICFEYIQNNYNFIKSDISIFNKYDDHIKVDNYISNNIDVVNKHNSLLSEHVINATNIIENIMTSIVEINEDTEMNSLEETQDKLLELYENFKKEKNIINNNYKIVHFNKLKEIENSLETYNSISTNFNKINETQNIDILKNEFNNIKTKINDKVKELVHVDSTLTLESIQTFNNLYGDLMSNIQDVYKYEDINNVELKKVKLYIENITNLLGRINTFIKELDKYQDENNGIDKYIEINKENNSYIIKLKEKANNLKENFSKLLQNIKRNETELYNINNIKDDIMNTGKSVNNIKQKFSSNLPLKEKLFQMEEMLLNINNIMNETKRISNTAAYTNITLQDIENNKNKENNNMNIETIDKLIDHIKIHNEKIQAEILIIDDAKRKVKEITDNINKAFNEITENYNNENNGVIKSAKNIVDEATYLNNELDKFLLKLNELLSHNNNDIKDLGDEKLILKEEEERKERERLEKAKQEEERKERERIEKEKQEKERLEREKQEQLKKEEELRKKEQERQEQQQKEEALKRQEQERLQKEEELKRQEQERLEREKQEQLQKEEELKRQEQERLQKEEALKRQEQERLQKEEELKRQEQERLEREKQEQLQKEEELKRQEQERLQKEEALKRQEQERLQKEEELKRQEQERLERKKIELAEREQHIKSKLESDMVKIIKDELTKEKDEIIKNKDIKLRHSLEQKWLKHLQNILSLKIDSLLNKNDEVIKDNETQLKTNILNSLKNQLYLNLKRELNEIIKEYEENQKKILHSNQLVNDSLEQKTNRLVDIKPTKHGDIYTNKLSDNETEMLITSKEKKDETESTKRSGTDHTNSSESTTDDNTNDRNFSRSKNLSVAIYTAGSVALCVLIFSSIGLLLIKTNSGDNNSNEINEAFEPNDDVLFKEKDEIIEITFNDNDSTI

SEQ ID NO: 12 - DNA, 9393 bp, Plasmodium falciparum
atgaagaccacactattttgtagcatatctttttgtaatattatatttttcttcttagaattaagtcatgagcattttgttggacaatcaagtaatacccatggagcatcttcagttactgattttaattttagtgaggagaaaaatttaaaaagttttgaagggaagaataataataatgataattatgcttcaattaatcgtttatataggaagaaaccatatatgaagagatcgcttataaatttagaaaatgatctttttagattagaacctatatcttatattcaaagatattataagaagaatataaacagatctgatatttttcataataaaaaagaaagaggttccaaagtatattcaaatgtgtcttcattccattcttttattcaagagggtaaagaagaagttgaggttttttctatatggggtagtaatagcgttttagatcatatagatgttcttagggataatggaactgtcgttttttctgttcaaccatattaccttgatatatatacgtgtaaagaagccatattatttactacatcattttacaaggatcttgataaaagttcaattacaaaaattaatgaagatattgaaaaatttaacgaagaaataatcaagaatgaagaacaatgtttagttggtgggaaaacagattttgataatttacttatagttttagaaaatgcggaaaaagcaaatgttagaaaaacattatttgataatacatttaatgattataaaaataagaaatctagtttttacaattgtttgaaaaataaaaaaaatgattatgataagaaaataaagaatataaagaatgagattacaaaattgttaaaaaatattgaaagtacaggaaatatgtgtaaaacggaatcatatgttatgaataataatttatatctattaagagtgaatgaagttaaaagtacacctattgatttatacttaaatcgagcaaaagagctattagaatcaagtagcaaattagttaatcctataaaaatgaaattaggtgataataagaacatgtactctattggatatatacatgacgaaattaaagatattataaaaagatataattttcatttgaaacatatagaaaaaggaaaagaatatataaaaaggataacacaagcaaataatattgcagacaaaatgaagaaagatgaacttataaaaaaaatttttgaatcctcaaaacattttgctagttttaaatatagcaatgaaatgataagcaaattagattcgttatttataaaaaatgaagaaatacttaataatttattcaataatatatttaatatattcaagaaaaaatatgaaacatatgtagatatgaaaacaattgaatctaaatatacaacagtaatgactctatcagaacatttattagaatatgcaatggatgttttaaaagctaaccctcaaaaacctattgatccaaaagcaaatctggattcagaagtagtaaaattacaaataaaaataaatgagaaatcaaatgaattagataatgctataagtcaagtaaaaacactaataataataatgaaatcattttatgatattattatatctgaaaaagcctctatggatgaaatggaaaaaaaggaattatccttaaataattatattgaaaaaacagattatatattacaaacgtataatatttttaagtctaaaagtaatattataaataataatagtaaaaatattagttctaaatatataactatagaagggttaaaaaatgatattgatgaattaaatagtcttatatcatattttaaggattcacaagaaacattaataaaagatgatgaattaaaaaaaaacatgaaaacggattatcttaataacgtgaaatatatagaagaaaatgttactcatataaatgaaattatattattaaaagattctataactcaacgaatagcagatattgatgaattaaatagtttaaatttaataaatataaatgattttataaatgaaaagaatatatcacaagagaaagtatcatataatcttaataaattatataaaggaagttttgaagaattagaatctgaactatctcattttttagacacaaaatatttgtttcatgaaaaaaaaagtgtaaatgaacttcaaacaattttaaatacatcaaataatgaatgtgctaaattaaattttatgaaatctgataataataataataataataatagtaatataattaacttgttaaaaactgaattaagtcatctattaagtcttaaagaaaatataataaaaaaacttttaaatcatatagaacaaaatattcaaaactcatcaaataagtatactattacatatactgatattaataatagaatggaagattataaagaagaaatcgaaagtttagaagtatataaacataccattggaaatatacaaaaagaatatatattacatttatatgagaatgataaaaatgctttagctgtacataatacatcaatgcaaatattacaatataaagatgctatacaaaatataaaaaataaaatttctgatgatataaaaattttaaagaaatataaagaaatgaatcaagatttattaaattattatgaaattctagataaaaaattaaaagataatacatatatcaaagaaatgcatactgcttctttagttcaaataactcaatatattccttatgaagataaaacaataagtgaacttgagcaagaatttaataataataatcaaaaacttgataatatattacaagatatcaatgcaatgaatttaaatataaatattctccaaaccttaaatattggtataaatgcatgtaatacaaataataaaaatgtagaacacttacttaacaagaaaattgaattaaaaaatatattaaatgatcaaatgaaaattataaaaaatgatgatataattcaagataatgaaaaagaaaacttttcaaatgttttaaaaaaagaagaggaaaaattagaaaaagaattagatgatatcaaatttaataatttgaaaatggacattcataaattgttgaattcgtatgaccatacaaagcaaaatatagaaagcaatcttaaaataaatttagattctttcgaaaaggaaaaagatagttgggttcattttaaaagtactatagatagtttatatgtggaatataacatatgtaatcaaaagactcataatactatcaaacaacaaaaaaatgatatcatagaacttatttataaacgtataaaagatataaatcaagaaataatcgaaaaggtagataattattattccctgtcagataaagccttaactaaacttaaatctattcattttaatattgataaggaaaaatataaaaatcccaaaagtcaagaaaatattaaattattagaagatagagttatgatacttgagaaaaagattaaggaagataaagatgctttaatacaaattaagaatttatcacatgatcattttgtaaatgctgataatgagaaaaaaaagcagaaggagaaggaggaggacgacgaacaaacacactatagtaaaaaaagaaaagtaatgggagatatatataaggatattaaaaaaaacctagatgagttaaataataaaaatttgatagatattactttaaatgaagcaaataaaatagaatcagaatatgaaaaaatattaattgatgatatttgtgaacaaattacaaatgaagcaaaaaaaagtgatactattaaggaaaaaatcgaatcatataaaaaagatattgattatgtagatgtggacgtttccaaaacgaggaacgatcatcatttgaatggagataaaatacatgattcttttttttatgaagatacattaaattataaagcatattttgataaattaaaagatttatatgaaaatataaacaagttaacaaatgaatcaaatggattaaaaagtgatgctcataataacaacacacaagttgataaactaaaagaaattaatttacaagtattcagcaatttaggaaatataattaaatatgttgaaaaacttgagaatacattacatgaacttaaagatatgtacgaatttctagaaacgatcgatattaataaaatattaaaaagtattcataatagcatgaagaaatcagaagaatatagtaatgaaacgaaaaaaatatttgaacaatcagtaaatataactaatcaatttatagaagatgttgaaatattgaaaacgtctattaacccaaactatgaaagcttaaatgatgatcaaattgatgataatataaaatcacttgttctaaagaaagaggaaatatccgaaaaaagaaaacaagtgaataaatacataacagatattgaatctaataaagaacaatcagatttacatttacgatatgcatctagaagtatatatgttattgatctttttataaaacatgaaataataaatcctagcgatggaaaaaattttgatattataaaggttaaagaaatgataaataaaaccaaacaagtttcaaatgaagctatggaatatgctaataaaatggatgaaaaaaataaggacattataaaaatagaaaatgaactttataatttaattaataataacatccgttcattaaaaggggtaaaatatgaaaaagttaggaaacaagcaagaaatgcaattgatgatataaataatatacattctaatattaaaacgattttaaccaaatctaaagaacgattagatgagattaagaaacaacctaacattaaaagagaaggtgatgttttaaataatgataaaaccaaaatagcttatattacaatacaaataaataacggaagaatagaatctaatttattaaatatattaaatatgaaacataacatagatactatcttgaataaagctatggattatatgaatgatgtatcaaaatctgaccagattgttattaatatagattctttgaatatgaacgatatatataataaggataaagatcttttaataaatattttaaaagaaaaacagaatatggaggcagaatataaaaaaatgaatgaaatgtataattacgttaatgaaacagaaaaagaaataataaaacataaaaaaaattatgaaataagaattatggaacatataaaaaaagaaacaaatgaaaaaaaaaaaaaatttatggaatctaataacaaatcattaactactttaatggattcattcagatctatgttttataatgaatatataaatgattataatataaatgaaaattttgaaaaacatcaaaatatattgaatgaaatatataatggatttaatgaatcatataatattattaatacaaaaatgactgaaattataaatgataatttagattataatgaaataaaagaaattaaagaagtagcacaaacagaatatgataaacttaataaaaaagttgatgaattaaaaaattatttgaataatattaaagaacaagaaggacatcgattaattgattatataaaagaaaaaatatttaacttatatataaaatgttcagaacaacaaaatataatagatgattcttataattatattacagttaaaaaacagtatattaaaactattgaagatgtgaaatttttattagattcattgaacacaatagaagaaaaaaataaatcagtagcaaatctagaaatttgtactaataaagaagatataaaaaatttacttaaacatgttataaagttggcaaatttttcaggtattattgtaatgtctgatacaaatacggaaataactccagaaaatcctttagaagataatgatttattaaatttacaattatattttgaaagaaaacatgaaataacatcaacattggaaaatgattctgatttagagttagatcatttaggtagtaattcggatgaatctatagataatttaaaggtttataatgatattatagaattacacacatattcaacacaaattcttaaatatttagataatattcaaaaacttaaaggagattgcaatgatttagtaaaggattgtaaagaattacgtgaattgtctacggcattatatgatttaaaaatacaaattactagtgtaattaatagagaaaatgatatttcaaataatattgatattgtatctaataaattaaatgaaatagatgctatacaatataattttgaaaaatataaagaaatttttgataatgtagaagaatataaaacattagatgatacaaaaaatgcatatattgtaaaaaaggctgaaattttaaaaaatgtagatataaataaaacaaaagaagatttagatatatattttaatgacttagacgaattagaaaaatctcttacattatcatctaatgaaatggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggctgcatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgatgaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagagagagaaagaatagaaaaagaaaaacaagagaaagaaagactggaaagagagaaacaagaacaactaaaaaaagaagaagaattaagaaaaaaagagcaggaaagacaagaacaacaacaaaaagaagaagcattaaaaagacaagaacaagaacgactacaaaaagaagaagaattaaaaagacaagagcaagaaaggctggaaagagagaaacaagaacaactacaaaaagaagaagaattaaaaagacaagaacaagaacgactacaaaaagaagaagcattaaaaagacaagaacaagaacgactacaaaaagaagaagaattaaaaagacaagagcaagaaaggctggaaagagagaaacaagaacaactacaaaaagaagaagaattaaaaagacaagaacaagaacgactacaaaaagaagaagcattaaaaagacaagaacaagaacgactacaaaaagaagaagaattaaaaagacaagagcaagaaagactggaaagaaagaaaatcgagttagcagaaagagaacaacacataaaaagtaaactagaatctgatatggtgaaaataataaaggatgaactaacaaaagaaaaagatgaaataataaaaaacaaagatataaaacttagacatagtttggaacagaaatggttaaaacatttacaaaatatattatcgttaaaaatagatagtctattaaataaaaatgatgaggtcataaaagataatgagacacaattgaaaacaaatatattgaactcattaaaaaatcaattatatcttaatttgaaacgtgaacttaatgaaattataaaggaatacgaagaaaaccagaaaaaaatattgcattcaaatcaacttgttaacgatagtttagagcaaaaaactaatagactcgtcgatattaaacctacaaagcatggtgatatatatactaataaactttctgataatgaaactgaaatgctgataacatctaaagaaaaaaaagatgaaacagaatcaactaaaagatcaggaacagatcatactaatagttcggaaagtactactgatgataataccaatgatagaaatttttctcgatcaaagaatttgagtgttgctatatacacagcaggaagtgtagctttatgtgtgttaatattttctagtataggattattacttataaagactaatagtggagataacaattctaatgaaattaatgaagcttttgaaccgaatgatgatgttctctttaaggagaaggatgaaatcattgaaatcacttttaatgataatgatagtacaatttaa

SEQ ID NO: 13 - protein, 2971 aa, Plasmodium falciparum
MQRWIFCNIVLHILIYLAEFSHEQESYSSNEKIRKDYSDDNNYEPTPSYEKRKKEYGKDESYIKNYRGNNFSYDLSKNSSIFLHMGNGSNSKTLKRCNKKKNIKTNFLRPIEEEKTVLNNYVYKGVNFLDTIKRNDSSYKFDVYKDTSFLKNREYKELITMQYDYAYLEATKEVLYLIPKDKDYHKFYKNELEKILFNLKDSLKLLREGYIQSKLEMIRIHSDIDILNEFHQGNIINDNYFNNEIKKKKEDMEKYIREYNLYIYKYENQLKIKIQKLTNEVSINLNKSTCEKNCYNYILKLEKYKNIIKDKINKWKDLPEIYIDDKSFSYTFLKDVINNKIDIYKTISSFISTQKQLYYFEYIYIMNKNTLNLLSYNIQKTDINSSSKYTYTKSHFLKDNHILLSKYYTAKFIDILNKTYYYNLYKNKILLFNKYIIKLRNDLKEYAFKSIQFIQDKIKKHKDELSIENILQEVNNIYIKYDTSINEISKYNNLIINTDLQIVQQKLLEIKQKKNDITHKVQLINHIYKNIHDEILNKKNNEITKIIINNIKDHKKDLQDLLLFIQQIKQYNILTDHKITQCNNYYKEIIKMKEDINHIHIYIQPILNNLHTLKQVQNNKIKYEEHIKQILQKIYDKKESLKKIILLKDEAQLDITLLDDLIQKQTKKQTQTQTQTQKQTLIQNNETIQLISGQEDKHESNPFNHIQTYIQQKDTQNKNIQNLLKSLYNGNINTFIDTISKYILKQKDIELTQHVYTDEKINDYLEEIKNEQNKIDKTIDDIKIQETLKQITHIVNNIKTIKKDLLKEFIQHLIKYMNERYQNMQQGYNNLTNYINQYEEENNNMKQYITTIRNIQKIYYDNIYAKEKEIRSGQYYKDFITSRKNIYNIRENISKNVDMIKNEEKKKIQNCVDKYNSIKQYVKMLKNGDTQDENNNNNNDIYDKLIVPLDSIKQNIDKYNTEHNFITFTNKINTHNKKNQEMMEEFIYAYKRLKILKILNISLKACEKNNKSINTLNDKTQELKKIVTHEIDLLQKDILTSQISNKNVLLLNDLLKEIEQYIIDVHKLKKKSNDLFTYYEQSKNYFYFKNKKDNFDIQKTINKMNEWLAIKNYINEINKNYQTLYEKKINVLLHNSKSYVQYFYDHIINLILQKKNYLENTLKTKIQDNEHSLYALQQNEEYQKVKNEKDQNEIKKIKQLIEKNKNDILTYENNIEQIEQKNIELKTNAQNKDDQIVNTLNEVKKKIIYTYEKVDNQISNVLKNYEEGKVEYDKNVVQNVNDADDTNDIDEINDIDEINDIDEINDIDEINDIDEIKDIDHIKHFDDTKHFDDIYHADDTRDEYHIALSNYIKTELRNINLQEIKNNIIKIFKEFKSAHKEIKKESEQINKEFTKMDVVINQLRDIDRQMLDLYKELDEKYSEFNKTKIEEINNIRENINNVEIWYEKNIIEYFLRHMNDQKDKAAKYMENIDTYKNNIEIISKQINPENYVETLNKSNMYSYVEKANDLFYKQINNIIINSNQLKNEAFTIDELQNIQKNRKNLLTKKQQIIQYTNEIENIFNEIKNINNILVLTNYKSILQDISQNINHVSIYTEQLHNLYIKLEEEKEQMKTLYHKSNVLHNQINFNEDAFINNLLINIEKIKNDITHIKEKTNIYMIDVNKSKNNAQLYFHNTLRGNEKIEYLKNLKNSTNQQITLQELKQVQENVEKVKDIYNQTIKYEEEIKKNYHIITDYENKINDILHNSFIKQINMESSNNKKQTKQIIDIINDKTFEEHIKTSKTKINMLKEQSQMKHIDKTLLNEQALKLFVDINSTNNNLDNMLSEINSIQNNIHTYIQEANKSFDKFKIICDQNVNDLLNKLSLGDLNYMNHLKNLQNEIRNMNLEKNFMLDKSKKIDEEEKKLDILKVNISNINNSLDKLKKYYEEALFQKVKEKAEIQKENIEKIKQEINTLSDVFKKPFFFIQLNTDSSQHEKDINNNVETYKNNIDEIYNVFIQSYNLIQKYSSEIFSSTLNYIQTKEIKEKSIKEQNQLNQNEKEASVLLKNIKINETIKLFKQIKNERQNDVHNIKEDYNLLQQYLNYMKNEMEQLKKYKNDVHMDKNYVENNNGEKEKLLKETISSYYDKINNINNKLYIYKNKEDTYFNNMIKVSEILNIIIKKKQQNEQRIVINAEYDSSLINKDEEIKKEINNQIIELNKHNENISNIFKDIQNIKKQSQDIITNMNDMYKSTILLVDIIQKKEEALNKQKNILRNIDNILNKKENIIDKVIKCNCDDYKDILIQNETEYQKLQNINHTYEEKKKSIDILKIKNIKQKNIQEYKNKLEQMNTIINQSIEQHVFINADILQNEKIKLEEIIKNLDILDEQIMTYHNSIDELYKLGIQCDNHLITTISVVVNKNTTKIMIHIKKQKEDIQKINNYIQTNYNIINEEALQFHRLYGHNLISEDDKNNLVHIIKEQKNIYTQKEIDISKIIKHVKKGLYSLNEHDMNHDTHMNIINEHINNNILQPYTQLINMIKDIDNVFIKIQNNKFEQIQKYIEIIKSLEQLNKNINTDNLNKLKDTQNKLINIETEMKHKQKQLINKMNDIEKDNITDQYMHDVQQNIFEPITLKMNEYNTLLNDNHNNNINNEHQFNHLNSLHTKIFSHNYNKEQQQEYITNIMQRIDVFINDLDTYQYEYYFYEWNQEYKQIDKNKINQHINNIKNNLIHVKKQFEHTLENIKNNENIFDNIQLKKKDIDDIIININNTKETYLKELNKKKNVTKKKKVDEKSEINNHHTLQHDNQNVEQKNKIKDHNLITKPNNNSSEESHQNEQMKEQNKNILEKQTRNIKPHHVHNHNHNHNQNQKDSTKLQEQDISTHKLHNTIHEQQSKDNHQGNREKKQKNGNHERMYFASGIVVSILFLFSFGFVINSKNNKQEYDKEQEKQQQNDFVCDNNKMDDKSTQKYGRNQEEVMEIFFDNDYI

SEQ ID NO: 14 - DNA, 8916 bp, Plasmodium falciparum
atgcaaaggtggattttctgcaacattgttttgcatatattaatttacttagcagaatttagccatgaacaggaaagttattcttccaatgaaaaaataagaaaggactattcagatgataataattatgaacctaccccttcatatgaaaaaagaaaaaaagaatatggaaaagatgaaagttatataaaaaattacagaggtaataatttttcctatgatttgtctaaaaattctagtatatttcttcacatgggtaacggtagtaactcgaaaacactaaaaagatgtaacaagaaaaaaaatataaagaccaattttttaagacctatcgaggaagagaaaacggtattaaataattatgtatataaaggtgtaaattttttagatacaataaaaagaaatgattcctcttataaatttgatgtttataaagatacttcctttttaaaaaatagagaatataaagaattaattactatgcagtatgattatgcttatttagaagcaacaaaagaggttctttatttaattccgaaggataaagattatcacaaattttataaaaatgaacttgagaaaattcttttcaatttaaaagattcacttaaattattaagagaaggatatatacaaagcaaactggaaatgattagaatccattcggatatagatatattaaatgagtttcatcaaggaaatattataaacgataattattttaataatgaaataaaaaaaaaaaaggaagacatggaaaaatatataagagaatataatttatacatatataaatatgaaaatcagcttaaaataaaaatacagaaattaacaaatgaagtttctataaatttaaataaatctacatgtgaaaagaattgttataattatattttaaaattagaaaaatataaaaatataataaaagataagataaataaatggaaagatttaccagaaatatatattgatgataaaagtttctcatatacatttttaaaagatgtaataaataataagatagatatatataaaacaataagttcttttatatctactcagaaacaattatattattttgaatatatatatataatgaataaaaatacattaaacctactttcatataatatacaaaaaacagatataaattctagtagtaaatacacatatacaaaatctcattttttaaaagataatcatatattgttatctaaatattatactgccaaatttattgatatcctaaataaaacatattattataatttatataaaaataaaattcttttattcaataaatatattataaagcttagaaacgatttaaaagaatatgcatttaaatctatacaatttattcaagataaaatcaaaaaacataaagatgaattatccatagaaaatatattacaagaagttaataatatatatataaaatatgatacttcgataaatgaaatatctaaatataacaatttaattattaatactgatttacaaatagtacaacaaaaacttttagaaatcaaacaaaaaaaaaatgatattacacacaaagtacaacttataaatcatatatataaaaatatacatgatgaaatattaaacaaaaaaaataatgaaataacaaagattattataaataatataaaagatcataaaaaagatttacaagatctcttactatttatacaacaaatcaaacaatataatatattaacagatcataaaattacacaatgtaataattattataaggaaatcataaaaatgaaagaagatataaatcatattcatatatatatacaaccaattctaaataatttacacacattaaaacaagtacaaaataataaaatcaaatatgaagagcacatcaaacaaatattacaaaaaatttatgataaaaaggaatctttaaaaaaaattattctcttaaaagatgaagcacaattagacattaccctcctcgatgacttaatacaaaagcaaacaaaaaaacaaacacaaacacaaacacaaacacaaaaacaaacactaatacaaaataatgagacgattcaacttatttctggacaagaagataaacatgaatccaatccatttaatcatatacaaacctatattcaacaaaaagatacacaaaataaaaacatccaaaatcttcttaaatccttgtataatggaaatattaacacattcatagacacaatttctaaatatatattaaaacaaaaagatatagaattaacacaacacgtttatacagacgaaaaaattaatgattatcttgaagaaataaaaaatgaacaaaacaaaatagataagaccatcgacgatataaaaatacaagaaacattaaaacaaataactcatattgttaacaatataaaaaccatcaaaaaggatttgctcaaagaatttattcaacatttaataaaatatatgaacgaaagatatcagaatatgcaacagggttataataatttaacaaattatattaatcaatatgaagaagaaaataataatatgaaacaatatattactaccatacgaaatatccaaaaaatatattatgataatatatatgctaaggaaaaggaaattcgctcgggacaatattataaggattttatcacatcaaggaaaaatatttataatataagggaaaatatatccaaaaatgtagatatgataaaaaatgaagaaaagaagaaaatacagaattgtgtagataaatataattctataaaacaatatgtaaaaatgcttaaaaatggagacacacaagatgaaaataataataataataatgatatatacgacaagttaattgtcccccttgattcaataaaacaaaatatcgataaatacaacacagaacataattttataacatttacaaataaaataaatacacataataagaagaaccaagaaatgatggaagaattcatatatgcatataaaaggttaaaaattttaaaaatattaaatatatccttaaaagcttgtgaaaaaaataataaatctatcaatacattaaatgacaaaacacaagaattaaaaaaaattgtaacacacgaaatagatcttctacaaaaagatattttaacaagtcaaatatcaaataaaaatgttttattattaaacgatttattaaaagaaattgaacaatatattatagatgtacacaaattaaaaaaaaaatcaaacgatctatttacatattatgaacaatccaaaaattatttctattttaaaaacaaaaaagataattttgatatacaaaaaacaatcaataaaatgaatgaatggctagctatcaaaaattatataaatgaaattaataaaaattatcaaacattatatgaaaaaaaaataaatgtactcctacataattcaaaaagttatgtacaatacttttatgatcatataataaatctaattcttcaaaaaaaaaattatttggaaaatactttaaagacaaaaatacaagataacgaacattcactatatgctttacaacaaaatgaagaataccaaaaggtaaagaacgaaaaggatcaaaacgaaattaagaaaattaaacaattaatcgaaaaaaataaaaatgatatacttacatatgaaaacaacattgaacaaattgaacaaaaaaatattgagttaaaaacaaatgctcaaaataaggatgatcaaatagtaaataccttaaatgaggttaagaaaaaaataatatatacatatgaaaaggtagataatcaaatatcgaacgttttaaaaaattatgaagaaggaaaagtagaatatgataaaaatgttgtacaaaatgttaacgatgcggatgatacaaacgatattgatgaaataaacgatattgatgaaataaacgatattgatgaaataaacgatattgatgaaataaacgatattgatgaaataaaagacattgaccatataaaacattttgacgatacaaaacattttgacgatatataccatgctgatgatacacgtgatgaataccatatagccctttcaaattatataaagacagaactaagaaatataaacctgcaagaaataaaaaacaatataataaaaatatttaaagaattcaaatctgcacacaaagaaattaaaaaagaatcagaacaaattaataaagaatttaccaaaatggatgtcgtcataaatcaattaagagatatagacagacaaatgcttgatctttataaagaattagatgaaaaatattctgaatttaataaaacaaaaattgaagaaataaataatataagggaaaatattaataatgtggaaatatggtatgaaaaaaatataattgaatatttcttacgtcatatgaatgatcaaaaagataaagctgcaaaatatatggaaaacattgatacatataaaaataatattgaaattattagtaaacaaataaatccagaaaattatgttgaaacattaaacaaatcaaatatgtattcttatgtagaaaaggctaatgatctattttataaacaaataaataatataatcataaattcaaatcaactaaaaaacgaagcttttacaatagatgaattacaaaatattcaaaaaaacagaaaaaatcttcttacaaagaaacaacaaattattcagtatacaaatgaaatagaaaatatatttaatgaaattaaaaatattaataacatattagtcttaacaaattataaatctatccttcaagatatatcacaaaatataaatcatgttagtatatatacggaacaattacataatttatatataaaattagaagaagaaaaagaacaaatgaaaacactctatcataaatcaaatgtgttacataaccaaattaattttaatgaagatgcttttattaataatttattaattaatatagaaaaaattaaaaatgatattacacatataaaggaaaaaacaaatatatatatgatagatgtaaacaaatctaaaaataatgctcaactatattttcataatacactaagaggtaatgaaaaaatagaatatttaaaaaatcttaagaattcaacaaaccaacaaataactttacaagaattaaaacaagtacaagaaaatgttgagaaggtaaaagatatatacaatcaaactataaaatatgaagaagaaattaaaaaaaattatcatattataacagattatgagaataaaataaatgatattttacataattcatttattaaacaaataaatatggaatctagcaataataaaaaacaaacaaaacaaattatagacataataaacgataaaacatttgaagaacatataaaaacatccaaaaccaaaataaacatgctaaaagaacaatcacaaatgaaacatatagacaaaactttattaaatgaacaagcactcaaattatttgtagatattaattctactaataataatttagataatatgttatctgaaataaattctatacaaaataatatacatacatatatccaagaagcaaacaaatcatttgacaaatttaaaattatatgtgatcaaaatgtaaacgatttattaaacaaattaagtttaggagatctaaattatatgaatcatttaaaaaatctgcaaaacgaaataagaaacatgaatctagaaaaaaatttcatgttagataaaagtaaaaaaatagatgaggaagaaaaaaaattagatatattaaaagttaacatatcaaatataaataattctttagataaattaaaaaaatattacgaagaagcgctctttcaaaaggttaaagaaaaagcagaaattcaaaaggaaaatatagaaaaaataaaacaagaaataaatacactgagcgatgtttttaagaaaccatttttttttatacaacttaatacagattcatcacaacatgaaaaagatataaacaataatgtagaaacatataaaaataatatagatgaaatatataatgtttttatacaatcatataatttaatacaaaaatattcttcagaaattttttcatccaccttgaattatatacaaacaaaagaaataaaagaaaaatccataaaggaacaaaaccaattaaatcaaaatgaaaaggaagcatctgttttattaaaaaatataaaaataaatgaaaccataaaattatttaaacaaataaaaaatgaaagacaaaacgatgtacacaatataaaagaggactataacttgttacaacaatatttaaattatatgaaaaatgaaatggaacaattaaaaaaatataaaaatgatgttcatatggataaaaattatgttgaaaataataatggtgaaaaagaaaaattacttaaagaaaccatttcttcatattatgataaaataaataatataaataataagctatatatatataaaaacaaagaagacacttattttaataatatgatcaaagtatcagaaattttaaacataattataaaaaaaaaacaacaaaatgaacaaagaattgttataaatgcagaatatgactcttcattaattaataaggatgaagaaattaaaaaagaaattaataatcaaataattgaattaaataaacataatgaaaatatttccaatatttttaaggatatacaaaatataaaaaaacaaagtcaagatattatcacaaatatgaacgacatgtataaaagtacaatccttttagtagacatcatacagaaaaaagaagaagctctaaataaacaaaaaaatattttaagaaatatagacaatatattaaataaaaaagaaaatattatagataaagttataaaatgtaattgtgatgattataaagatatcttaatacaaaacgaaacggaatatcaaaaattacaaaatataaatcatacatatgaagaaaaaaaaaaatcaatagatatattaaaaattaaaaatataaaacaaaaaaatattcaagaatataaaaacaaattagaacaaatgaatacaataattaatcaaagtatagaacaacatgtattcataaacgctgatattttacaaaatgaaaaaataaaattagaagaaatcataaaaaatctagatatactagatgaacaaattatgacatatcataattcaatagatgaattatataaactaggaatacaatgtgacaatcatctaattacaactattagtgttgttgttaataaaaatacaacaaaaattatgatacatataaaaaaacaaaaagaggatatacaaaaaattaataactatattcaaacaaattataatataataaatgaagaagctctacaatttcacaggctctatggacacaatcttataagtgaagatgacaaaaataatttggtacatattataaaagaacaaaagaatatatatacacaaaaggaaatagatatttctaaaataattaaacatgttaaaaaaggattatattcattgaatgaacatgatatgaatcatgatacacatatgaatataataaatgaacatataaataataatattttacaaccatacacacaattaataaacatgataaaagatattgataatgtttttataaaaatacaaaataataaattcgaacaaatacaaaaatatatagaaattattaaatctttagaacaattaaataaaaatataaacacagataatttaaataaattaaaagatacacaaaacaaattaataaatatagaaacagaaatgaaacataaacaaaaacaattaataaacaaaatgaatgatatagaaaaggataatattacagatcaatatatgcatgatgttcagcaaaatatatttgaacctataacattaaaaatgaatgaatataatacattattaaatgataatcataataataatataaataatgaacatcaatttaatcatttaaatagtcttcatacaaaaatatttagtcataattataataaagaacaacaacaagaatatataaccaacatcatgcaaagaattgatgtattcataaatgatttagatacttaccaatatgaatattatttttatgaatggaatcaagaatataaacaaatagacaaaaataaaataaatcaacatataaacaatattaaaaataatctaattcatgttaagaaacaatttgaacacaccttagaaaatataaaaaataatgaaaatattttcgacaacatacaattgaaaaaaaaagatattgacgatattattataaacattaataatacaaaagaaacatatctaaaagaattgaacaaaaaaaaaaatgttacaaaaaaaaaaaaagttgatgaaaaatcagaaataaataatcatcacacattacaacatgataatcaaaatgttgaacaaaaaaataaaattaaagatcataatttaataaccaagccaaataacaattcatcagaagaatctcatcaaaatgaacaaatgaaagaacaaaacaaaaatatacttgaaaaacaaacaagaaatatcaaaccacatcatgttcataatcataatcataatcataatcaaaatcaaaaagattcaacaaaattacaggaacaagatatatctacacacaaattacataatactatacatgagcaacaaagtaaagataatcatcaaggtaatagagaaaaaaaacaaaaaaatggaaaccatgaaagaatgtattttgccagtggaatagttgtatccattttatttttatttagttttggatttgttataaatagtaaaaataataaacaagaatatgataaagagcaagaaaaacaacaacaaaatgattttgtatgtgataataacaaaatggatgataaaagcacacaaaaatatggtagaaatcaagaagaggtaatggagatattttttgataatgattatatttaa

SEQ ID NO: 15 - DNA, 23 bp, Artificial Sequence
  Synthetic primer
cgcggatcccagcaaagaaaaga

SEQ ID NO: 16 - DNA, 36 bp, Artificial Sequence
  Synthetic primer
gcgactcgagttattaaaaatgagaacgcagatccg

SEQ ID NO: 17 - DNA, 32 bp, Artificial Sequence
  Synthetic primer
cgcggatcccatcgacagtgaaaacgagaagc

SEQ ID NO: 18 - DNA, 38 bp, Artificial Sequence
  Synthetic primer
gcgctcgagttattaaatctcgttcagcttattcagga

SEQ ID NO: 19 - DNA, 36 bp, Artificial Sequence
  Synthetic primer
cgcggatcccaagaacgagtttctgaataaattcat

SEQ ID NO: 20 - DNA, 30 bp, Artificial Sequence
  Synthetic primer
gcgagactcgagttattagatattttgcat

SEQ ID NO: 21 - DNA, 38 bp, Artificial Sequence
  Synthetic primer
cgcggatcccatcaataacgacgataactttattgaat

SEQ ID NO: 22 - DNA, 39 bp, Artificial Sequence
  Synthetic primer
gcgctcgagttattatttgaacagattgattttcgtttg

SEQ ID NO: 23 - DNA, 10130 bp, Plasmodium falciparum
  ref <308>: DATABASE ACCESSION NUMBER: Genbank accession no: AY138500
ctatttaaattatgaagaccacactattttgtagcatatctttttgtaatattatatttttcttcttaggtaaaataatatatacattcgaaaacaaattgtgctttgatgttgttcatattttaataattttgtatttttagatctttacaaaggctgtacaatgttctacgttgtgttagtctataatatttactactaaagcgtgtatatatatatatatatatatatatatatttatatatttatatatttatatttttatattttgtttcacattcagaattaagtcatgagcattttgttggacaatcaagtaatacccatggagcatcttcagttactgattttaattttagtgaggagaaaaatttaaaaagttttgaagggaagaataataataatgataattatgcttcaattaatcgtttatataggaagaaaccatatatgaagagatcgcttataaatttagaaaatgatctttttagattagaacctatatcttatattcaaagatattataagaagaatataaacagatctgatatttttcataataaaaaagaaagaggttccaaagtatattcaaatgtgtcttcattccattcttttattcaagagggtaaagaagaagttgaggttttttctatatggggtagtaatagcgttttagatcatatagatgttcttagggataatggaactgtcgttttttctgttcaaccatattaccttgatatatatacgtgtaaagaagccatattatttactacatcattttacaaggatcttgataaaagttcaattacaaaaattaatgaagatattgaaaaatttaacgaagaaataatcaagaatgaagaacaatgtttagttggtgggaaaacagattttgataatttacttatagttttagaaaatgcggaaaaagcaaatgttagaaaaacattatttgataatacatttaatgattataaaaataagaaatctagtttttacaattgtttgaaaaataaaaaaaatgattatgataagaaaataaagaatataaagaatgagattacaaaattgttaaaaaatattgaaagtacaggaaatatgtgtaaaacggaatcatatgttatgaataataatttatatctattaagagtgaatgaagttaaaagtacacctattgatttatacttaaatcgagcaaaagagctattagaatcaagtagcaaattagttaatcctataaaaatgaaattaggtgataataagaacatgtactctattggatatatacatgacgaaattaaagatattataaaaagatataattttcatttgaaacatatagaaaaaggaaaagaatatataaaaaggataacacaagcaaataatattgcagacaaaatgaagaaagatgaacttataaaaaaaatttttgaatcctcaaaacattttgctagttttaaatatagcaatgaaatgataagcaaattagattcgttatttataaaaaatgaagaaatacttaataatttattcaataatatatttaatatattcaagaaaaaatatgaaacatatgtagatatgaaaacaattgaatctaaatatacaacagtaatgactctatcagaacatttattagaatatgcaatggatgttttaaaagctaaccctcaaaaacctattgatccaaaagcaaatctggattcagaagtagtaaaattacaaataaaaataaatgagaaatcaaatgaattagataatgctataagtcaagtaaaaacactaataataataatgaaatcattttatgatattattatatctgaaaaagcctctatggatgaaatggaaaaaaaggaattatccttaaataattatattgaaaaaacagattatatattacaaacgtataatatttttaagtctaaaagtaatattataaataataatagtaaaaatattagttctaaatatataactatagaagggttaaaaaatgatattgatgaattaaatagtcttatatcatattttaaggattcacaagaaacattaataaaagatgatgaattaaaaaaaaacatgaaaacggattatcttaataacgtgaaatatatagaagaaaatgttactcatataaatgaaattatattattaaaagattctataactcaacgaatagcagatattgatgaattaaatagtttaaatttaataaatataaatgattttataaatgaaaagaatatatcacaagagaaagtatcatataatcttaataaattatataaaggaagttttgaagaattagaatctgaactatctcattttttagacacaaaatatttgtttcatgaaaaaaaaagtgtaaatgaacttcaaacaattttaaatacatcaaataatgaatgtgctaaattaaattttatgaaatctgataataataataataataataatagtaatataattaacttgttaaaaactgaattaagtcatctattaagtcttaaagaaaatataataaaaaaacttttaaatcatatagaacaaaatattcaaaactcatcaaataagtatactattacatatactgatattaataatagaatggaagattataaagaagaaatcgaaagtttagaagtatataaacataccattggaaatatacaaaaagaatatatattacatttatatgagaatgataaaaatgctttagctgtacataatacatcaatgcaaatattacaatataaagatgctatacaaaatataaaaaataaaatttctgatgatataaaaattttaaagaaatataaagaaatgaatcaagatttattaaattattatgaaattctagataaaaaattaaaagataatacatatatcaaagaaatgcatactgcttctttagttcaaataactcaatatattccttatgaagataaaacaataagtgaacttgagcaagaatttaataataataatcaaaaacttgataatatattacaagatatcaatgcaatgaatttaaatataaatattctccaaaccttaaatattggtataaatgcatgtaatacaaataataaaaatgtagaacacttacttaacaagaaaattgaattaaaaaatatattaaatgatcaaatgaaaattataaaaaatgatgatataattcaagataatgaaaaagaaaacttttcaaatgttttaaaaaaagaagaggaaaaattagaaaaagaattagatgatatcaaatttaataatttgaaaatggacattcataaattgttgaattcgtatgaccatacaaagcaaaatatagaaagcaatcttaaaataaatttagattctttcgaaaaggaaaaagatagttgggttcattttaaaagtactatagatagtttatatgtggaatataacatatgtaatcaaaagactcataatactatcaaacaacaaaaaaatgatatcatagaacttatttataaacgtataaaagatataaatcaagaaataatcgaaaaggtagataattattattccctgtcagataaagccttaactaaacttaaatctattcattttaatattgataaggaaaaatataaaaatcccaaaagtcaagaaaatattaaattattagaagatagagttatgatacttgagaaaaagattaaggaagataaagatgctttaatacaaattaagaatttatcacatgatcattttgtaaatgctgataatgagaaaaaaaagcagaaggagaaggaggaggacgacgaacaaacacactatagtaaaaaaagaaaagtaatgggagatatatataaggatattaaaaaaaacctagatgagttaaataataaaaatttgatagatattactttaaatgaagcaaataaaatagaatcagaatatgaaaaaatattaattgatgatatttgtgaacaaattacaaatgaagcaaaaaaaagtgatactattaaggaaaaaatcgaatcatataaaaaagatattgattatgtagatgtggacgtttccaaaacgaggaacgatcatcatttgaatggagataaaatacatgattcttttttttatgaagatacattaaattataaagcatattttgataaattaaaagatttatatgaaaatataaacaagttaacaaatgaatcaaatggattaaaaagtgatgctcataataacaacacacaagttgataaactaaaagaaattaatttacaagtattcagcaatttaggaaatataattaaatatgttgaaaaacttgagaatacattacatgaacttaaagatatgtacgaatttctagaaacgatcgatattaataaaatattaaaaagtattcataatagcatgaagaaatcagaagaatatagtaatgaaacgaaaaaaatatttgaacaatcagtaaatataactaatcaatttatagaagatgttgaaatattgaaaacgtctattaacccaaactatgaaagcttaaatgatgatcaaattgatgataatataaaatcacttgttctaaagaaagaggaaatatccgaaaaaagaaaacaagtgaataaatacataacagatattgaatctaataaagaacaatcagatttacatttacgatatgcatctagaagtatatatgttattgatctttttataaaacatgaaataataaatcctagcgatggaaaaaattttgatattataaaggttaaagaaatgataaataaaaccaaacaagtttcaaatgaagctatggaatatgctaataaaatggatgaaaaaaataaggacattataaaaatagaaaatgaactttataatttaattaataataacatccgttcattaaaaggggtaaaatatgaaaaagttaggaaacaagcaagaaatgcaattgatgatataaataatatacattctaatattaaaacgattttaaccaaatctaaagaacgattagatgagattaagaaacaacctaacattaaaagagaaggtgatgttttaaataatgataaaaccaaaatagcttatattacaatacaaataaataacggaagaatagaatctaatttattaaatatattaaatatgaaacataacatagatactatcttgaataaagctatggattatatgaatgatgtatcaaaatctgaccagattgttattaatatagattctttgaatatgaacgatatatataataaggataaagatcttttaataaatattttaaaagaaaaacagaatatggaggcagaatataaaaaaatgaatgaaatgtataattacgttaatgaaacagaaaaagaaataataaaacataaaaaaaattatgaaataagaattatggaacatataaaaaaagaaacaaatgaaaaaaaaaaaaaatttatggaatctaataacaaatcattaactactttaatggattcattcagatctatgttttataatgaatatataaatgattataatataaatgaaaattttgaaaaacatcaaaatatattgaatgaaatatataatggatttaatgaatcatataatattattaatacaaaaatgactgaaattataaatgataatttagattataatgaaataaaagaaattaaagaagtagcacaaacagaatatgataaacttaataaaaaagttgatgaattaaaaaattatttgaataatattaaagaacaagaaggacatcgattaattgattatataaaagaaaaaatatttaacttatatataaaatgttcagaacaacaaaatataatagatgattcttataattatattacagttaaaaaacagtatattaaaactattgaagatgtgaaatttttattagattcattgaacacaatagaagaaaaaaataaatcagtagcaaatctagaaatttgtactaataaagaagatataaaaaatttacttaaacatgttataaagttggcaaatttttcaggtattattgtaatgtctgatacaaatacggaaataactccagaaaatcctttagaagataatgatttattaaatttacaattatattttgaaagaaaacatgaaataacatcaacattggaaaatgattctgatttagagttagatcatttaggtagtaattcggatgaatctatagataatttaaaggtttataatgatattatagaattacacacatattcaacacaaattcttaaatatttagataatattcaaaaacttaaaggagattgcaatgatttagtaaaggattgtaaagaattacgtgaattgtctacggcattatatgatttaaaaatacaaattactagtgtaattaatagagaaaatgatatttcaaataatattgatattgtatctaataaattaaatgaaatagatgctatacaatataattttgaaaaatataaagaaatttttgataatgtagaagaatataaaacattagatgatacaaaaaatgcatatattgtaaaaaaggctgaaattttaaaaaatgtagatataaataaaacaaaagaagatttagatatatattttaatgacttagacgaattagaaaaatctcttacattatcatctaatgaaatggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggatgcatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgataaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagagagagaaagaatagaaaaagaaaaacaagagaaagaaagactggaaagagagaaacaagaacaactaaaaaaagaagcattaaaaaaacaagagcaagaaagacaagaacaacaacaaaaagaagaagcattaaaaagacaagaacaagaacgactacaaaaagaagaagaattaaaaagacaagagcaagaaaggctggaaagagagaaacaagaacaactacaaaaagaagaagaattaagaaaaaaagagcaggaaaaacaacaacaaagaaatatccaagaattagaagagcaaaaaaagcctgaaataataaatgaagcattggtaaagggggataaaatactagaaggaagtgatcagagaaatatggaattaagcaaacctaacgttagtatggataatactaataatagtccaattagtaacagtgaaattacagaaagcgatgatattgataacagtgaaaatatacatactagtcatatgagtgacatcgaaagtacacaaactagtcatagaagtaacacccatgggcaacaaatcagtgatattgttgaagatcaaattacacatcctagtaatattggaggagaaaaaattactcataatgatgaaatttcaatcactggtgaaagaaataacattagcgatgttaatgattatagtgaaagtagcaacatatttgaaaatggtgacagtactataaataccagtacaagaaacacgtctagtacacatgatgaatcccatataagtcctatcagcaatgcgtatgatcatgttgtttcagataataaaaaaagtatggatgaaaacataaaagataaattaaagatagatgaaagtataactacagatgaacaaataagattagatgataattctaatattgttagaattgatagtactgaccaacgtgatgctagtagtcatggtagtagtaatagggatgatgatgaaataagtcatgttggtagcgacattcatatggatagtgttgatattcatgatagtattgacactgatgaaaatgctgatcacagacataatgttaactctgttgatagtcttagttctagtgattacactgatacacagaaagactttagtagtattattaaagatgggggaaataaagaaggacatgctgagaatgaatctaaagaatatgaatcccaaacagaacaaacacatgaagaaggaattatgaatccaaataaatattcaattagtgaagttgatggtattaaattaaatgaagaagctaaacataaaattacagaaaaactggtagatatctatccttctacatatagaacacttgatgaacctatggaaacacatggtccaaatgaaaaatttcatatgtttggtagtccatatgtaacagaagaagattacacggaaaaacatgattatgataagcatgaagatttcaataatgaaaggtattcaaaccataacaaaatggatgatttcgtatataatgctggaggagttgtttgttgtgtattattttttgcaagtattactttcttttctatggacagatcaaataaggatgaatgcgattttgatatgtgtgaagaagtaaataataatgatcacttatcgaattatgctgataaagaagaaattattgaaattgtgtttgatgaaaatgaagaaaaatatttttaactattacatagtttaataatgaatatataagaaaaagacataatattattagataagtaattaattgttgttaatataattttttatcttgtttaaatatttataaaaaaaaaaaaaaaaaaaaagtgataataaatata

SEQ ID NO: 24 - DNA, 10132 bp, Plasmodium falciparum
  ref <308>: DATABASE ACCESSION NUMBER: Genbank accession no: AY138501
ctatttaaattatgaagaccacactattttgtagcatatctttttgtaatattatatttttcttcttaggtaaaataatatatacattcgaaaacaaattgtgctttgatgttgttcatattttaataattttgtatttttagatctttacaaaggctgtacaatgttctacgttgtgttagtctataatatttactactaaagcgtgtatatatatatatatatatatatatttatatatttatatatttatatttttatattttgtttcacattcagaattaagtcatgagcattttgttggacaatcaagtaatacccatggagcatcttcagttactgattttaattttagtgaggagaaaaatttaaaaagttttgaagggaagaataataataatgataattatgcttcaattaatcgtttatataggaagaaaccatatatgaagagatcgcttataaatttagaaaatgatctttttagattagaacctatatcttatattcaaagatattataagaagaatataaacagatctgatatttttcataataaaaaagaaagaggttccaaagtatattcaaatgtgtcttcattccattcttttattcaagagggtaaagaagaagttgaggttttttctatatggggtagtaatagcgttttagatcatatagatgttcttagggataatggaactgtcgttttttctgttcaaccatattaccttgatatatatacgtgtaaagaagccatattatttactacatcattttacaaggatcttgataaaagttcaattacaaaaattaatgaagatattgaaaaatttaacgaagaaataatcaagaatgaagaacaatgtttagttggtgggaaaacagattttgataatttacttatagttttagaaaatgcggaaaaagcaaatgttagaaaaacattatttgataataaatttaaagattataaaaataagaaatctagtttttacaattgtttgaaaaataaaaaaaatgattatgataagaaaataaataatataaagaatgagattacaaaattgttaaaaaatattgaaggtacaggaaaaatgtgtaaaacggaatcatatgttatgaataataatttatatctattaagagtgaatgaagttaaaagtacacctattgatttatacttaaatcgagcaaaagagctattagaatcaagtagcaaattagttaatcctataaaaatgaaattaggtgataataagaacatgtactctattggatatatacatgacgaaattaaagatattataaaaagatataattttcatttgaaacatatagaaaaaggaaaagaatatataaaaaggataacacaagcaaataatattgcagacaaaatgaagaaagatgaacttataaaaaaaatttttgaatcctcaaaacattttgctagttttaaatatagcaatgaaatgataagcaaattagattcgttatttataaaaaatgaacaaatacttaataatttattcaataatatatttaatatattcaagaaaaaatatgaaacatatgtagatatgaaaacaattgaatctaaatatacaacagtaatgactctatcagaacatttattagaatatgcaatggatgttttaaaagctaaccctcaaaaacctattgatccaaaagcaaatctggattcagaagtagtaaaattacaaataaaaataaatgagaaatcaaatgaattagataatgctataagtcaagtaaacacactaataataataatgaaatcattttatgatattattatatctgaaaaagcctctatggatgaaatggaaaaaaaggaattatccttaaataattatattgaaaaaacagattatatattacaaacgtatgatatttttaagtctaaaagtaatattataaataataatagtaaaaatattagttctaaatatataattatagaagggttaaaaaattatattgatgaattaaatagtcttatatcagattttaaggattcacaagaaacattaataaaagatgatgaattaaaaaaaaacatgaaaacggattatcttaataacgtgaaatatatagaagaaaatgttactcatataaatgaaattatattattaaaacattctataaatcaacgaatagcagatattgatgaattaaatagtttaaatttaataaatataaatgattttataaatgaaaagaatatatcacaagagaaagtatcatataatcttaataaattatataaaggaagttttgaagaattagaatctgaactatctcattttttagacacaaaatatttgtttcatgaaaaaaaaagtgtaaatgaacttcaaacaattttaaatacatcaaataatgaatgtgctaaattaaattttatgaaatctgataataataataataataataataataatagtaatataattaacttgttaaaaactgaattaagtcatctattaagtcttaaagaaaatataataaaaaaacttttaaatcatatagaacaaaatattcaaaactcatcaaataagtatactattacatatactgatattaataatagaatggaagattataaagaagaaatcgaaagtttagaagtatataaacataccattggaaatatacaaaaagaatatatattacatttatatgagaatgataaaaatgctttagctgtacataatacatcaatgcaaatattacaatataaagatgctatacaaaatataaaaaataaaatttctgatgatataaaaattttaaagaaatataaagaaatgaatcaagatttattaaattattatgaaattctagataaaaaattaaaagataatacatatatcaaagaaatgcatactgcttctttagttcaaataactcaatatattccttatgaagataaaacaataagtgaacttgagcaagaatttaataataataatcaaaaacttgataatatattacaagatatcaatgcaatgaatttaaatataaatattctccaaaccttaaatattggtataaatgcatgtaatacaaataataaaaatgtagaacacttacttaacaagaaaattgaattaaaaaatatattaaatgatcaaatgaaaattataaaaaatgatgatataattcaagataatgaaaaagaaaacttttcaaatgttttaaaaaaagaagaggaaaaattagaaaaagaattagatgatatcaaatttaataatttgaaaatggacattcataaattgttgaattcgtatgaccatacaaagcaaaatatagaaagcaatcttaaaataaatttagattctttcgaaaaggaaaaagatagttgggttcattttaaaagtactatagatagtttatatgtggaatataacatatgtaatcaaaagactcataatactatcaaacaacaaaaaaatgatatcatagaacttatttataaacgtataaaagatataaatcaagaaataatcgaaaaggtagataattattattccctgtcagataaagccttaactaaacttaaatctattcattttaatattgataaggaaaaatataaaaatcccaaaagtcaagaaaatattaaattattagaagatagagttatgatacttgagaaaaagattaaggaagataaagatgctttaatacaaattaagaatttatcacatgatcattttgtaaatgctgataatgagaaaaaaaagcagaaggagaaggaggaggacgacgaacaaacacactatagtaaaaaaagaaaagtaatgggagatatatataaggatattaaaaaaaacctagatgagttaaataataaaaatttgatagatattactttaaatgaagcaaataaaatagaatcagaatatgaaaaaatattaattgatgatatttgtgaacaaattacaaatgaagcaaaaaaaagtgatactattaaggaaaaaatcgaatcatataaaaaagatattgattatgtagatgtggacgtttccaaaacgaggaacgatcatcatttgaatggagataaaatacatgattcttttttttatgaagatacattaaattataaagcatattttgataaattaaaagatttatatgaaaatataaacaagttaacaaatgaatcaaatggattaaaaagtgatgctcataataacaacacacaagttgataaactaaaagaaattaatttacaagtattcagcaatttaggaaatataattaaatatgttgaaaaacttgagaatacattacatgaacttaaagatatgtacgaatttctagaaacgatcgatattaataaaatattaaaaagtattcataatagcatgaagaaatcagaagaatatagtaatgaaacgaaaaaaatatttgaacaatcagtaaatataactaatcaatttatagaagatgttgaaatattgaaaacgtctattaacccaaactatgaaagcttaaatgatgatcaaattgatgataatataaaatcacttgttctaaagaaagaggaaatatccgaaaaaagaaaacaagtgaataaatacataacagatattgaatctaataaagaacaatcagatttacatttacgatatgcatctagaagtatatatgttattgatctttttataaaacatgaaataataaatcctagcgatggaaaaaattttgatattataaaggttaaagaaatgataaataaaaccaaacaagtttcaaatgaagctatggaatatgctaataaaatggatgaaaaaaataaggacattataaaaatagaaaatgaactttataatttaattaataataacatccgttcattaaaaggggtaaaatatgaaaaagttaggaaacaagcaagaaatgcaattgatgatataaataatatacattctaatattaaaacgattttaaccaaatctaaagaacgattagatgagattaagaaacaacctaacattaaaagagaaggtgatgttttaaataatgataaaaccaaaatagcttatattacaatacaaataaataacggaagaatagaatctaatttattaaatatattaaatatgaaacataacatagatactatcttgaataaagctatggattatatgaatgatgtatcaaaatctgaccagattgttattaatatagattctttgaatatgaacgatatatataataaggataaagatcttttaataaatattttaaaagaaaaacagaatatggaggcagaatataaaaaaatgaatgaaatgtataattacgttaatgaaacagaaaaagaaataataaaacataaaaaaaattatgaaataagaattatggaacatataaaaaaagaaacaaatgaaaaaaaaaaaaaatttatggaatctaataacaaatcattaactactttaatggattcattcagatctatgttttataatgaatatataaatgattataatataaatgaaaattttgaaaaacatcaaaatatattgaatgaaatatataatggatttaatgaatcatataatattattaatacaaaaatgactgaaattataaatgataatttagattataatgaaataaaagaaattaaagaagtagcacaaacagaatatgataaacttaataaaaaagttgatgaattaaaaaattatttgaataatattaaagaacaagaaggacatcgattaattgattatataaaagaaaaaatatttaacttatatataaaatgttcagaacaacaaaatataatagatgattcttataattatattacagttaaaaaacagtatattaaaactattgaagatgtgaaatttttattagattcattgaacacaatagaagaaaaaaataaatcagtagcaaatctagaaatttgtactaataaagaagatataaaaaatttacttaaacatgttataaagttggcaaatttttcaggtattattgtaatgtctgatacaaatacggaaataactccagaaaatcctttagaagataatgatttattaaatttacaattatattttgaaagaaaacatgaaataacatcaacattggaaaatgattctgatttagagttagatcatttaggtagtaattcggatgaatctatagataatttaaaggtttataatgatattatagaattacacacatattcaacacaaattcttaaatatttagataatattcaaaaacttaaaggagattgcaatgatttagtaaaggattgtaaagaattacgtgaattgtctacggcattatatgatttaaaaatacaaattactagtgtaattaatagagaaaatgatatttcaaataatattgatattgtatctaataaattaaatgaaataaatgctatacaatataattttgaaaaatataaagaaatttttgataatgtagaagaatataaaacattagatgatacaaaaaatgcatatattgtaaaaaaggctgaaattttaaaaaatgtagatataaataaaacaaaagaagatttagatatatattttaatgacttagacgaattagaaaaatctcttacattatcatctaatgaaatggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggctgcatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgatgaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagagagagaaagaatagaaaaagaaaaacaagagaaagaaagactggaaagagagaaacaagaacaactaaaaaaagaagcattaaaaaaacaagagcaagaaagacaagaacaacaacaaaaagaagaagcattaaaaagacaagaacaagaacgactacaaaaagaagaagaattaaaaagacaagagcaagaaaggctggaaagagagaaacaagaacaactacaaaaagaagaagaattaagaaaaaaagagcaggaaaaacaacaacaaagaaatatccaagaattagaagagcaaaaaaagcctgaaataataaatgaagcattggtaaagggggataaaatactagaaggaagtgatcagagaaatatggaattaagcaaacctaacgttagtatggataatactaataatagtccaattagtaacagtgaaattacagaaagcgatgatattgataacagtgaaaatatacatactagtcatatgagtgacatcgaaagtacacaaactagtcatagaagtaacacccatgggcaacaaatcagtgatattgttgaagatcaaattacacatcctagtaatattggaggagaaaaaattactcataatgatgaaatttcaatcactggtgaaagaaataacattagcgatgttaatgattatagtgaaagtagcaacatatttgaaaatggtgacagtactataaataccagtacaagaaacacgtctagtacacatgatgaatcccatataagtcctatcagcaatgcgtatgatcatgttgtttcagataataaaaaaagtatggatgaaaacataaaagataaattaaagatagatgaaagtataactacagatgaacaaataagattagatgataattctaatattgttagaattgatagtactgaccaacgtgatgctagtagtcatggtagtagtaatagggatgatgatgaaataagtcatgttggtagcgacattcatatggatagtgttgatattcatgatagtattgacactgatgaaaatgctgatcacagacataatgttaactctgttgatagtcttagttctagtgattacactgatacacagaaagactttagtagtattattaaagatgggggaaataaagaaggacatgctgagaatgaatctaaagaatatgaatcccaaacagaacaaacacatgaagaaggaattatgaatccaaataaatattcaattagtgaagttgatggtattaaattaaatgaagaagctaaacataaaattacagaaaaactggtagatatctatccttctacatatagaacacttgatgaacctatggaaacacatggtccaaatgaaaaatttcatatgtttggtagtccatatgtaacagaagaagattacacggaaaaacatgattatgataagcatgaagatttcaataatgaaaggtattcaaaccataacaaaatggatgatttcgtatataatgctggaggagttgtttgttgtgtattattttttgcaagtattactttcttttctatggacagatcaaataaggatgaatgcgattttgatatgtgtgaagaagtaaataataatgatcacttatcgaattatgctgataaagaagaaattattgaaattgtgtttgatgaaaatgaagaaaaatatttttaactattacatagtttaataatgaatatataagaaaaagacataatattattagataagtaattaattgttgttaatataattttttatcttgtttaaatatttataaaaaaaaaaaaaaaaaaaaagtgataataaatata

SEQ ID NO: 25 - DNA, 9979 bp, Plasmodium falciparum
  ref <308>: DATABASE ACCESSION NUMBER: Genbank accession no: AY138502
ctatttaaattatgaagatcacactattttgtagcatatctttttgtaatattatatttttcttcttaggtaaaataatatatacattcgaaaacaaattgtgctttgatgttgttcatattttaataattttgtatttttagatctttacaaaggctgtacaatgttctacgttgtgttagtctataatatttactactaaagcgtgtatatatatatatatatatatatatatatatatttatatatttatatatttatatttttatattttgtttcacattcagaattaagtcatgagcattttgttggacaatcaagtaatacccatggagcatcttcagttactgattttaattttagtgaggagaaaaatttaaaaagttttgaagggaagaataataataatgataattatgcttcaattaatcgtttatataggaagaaaccatatatgaagagatcgcttataaatttagaaaatgatctttttagattagaacctatatcttatattcaaagatattataagaagaatataaacagatctgatatttttcataataaaaaagaaagaggttccaaagtatattcaaatgtgtcttcattccattcttttattcaagagggtaaagaagaagttgaggttttttctatatggggtagtaatagcgttttagatcatatagatgttcttagggataatggaactgtcgttttttctgttcaaccatattaccttgatatatatacgtgtaaagaagccatattatttactacatcattttacaaggatcttgataaaagttcaattacaaaaattaatgaagatattgaaaaatttaacgaagaaataatcaagaatgaagaacaatgtttagttggtgggaaaacagattttgataatttacttatagttttagaaaatgcggaaaaagcaaatgttagaaaaacattatttgataataaatttaatgattataaaaataagaaatctagtttttacaattgtttgaaaaataaaaaaaatgattatgataagaaaataaataatataaagaatgagattacaaaattgttaaaaaatattgaaagtacaggaaatatgtgtaaaacggaatcatatgttatgaataataatttatatctattaagagtgaatgaagttaaaagtacacctattgatttatacttaaatcgagcaaaagagctattagaatcaagtagcaaattagttaatcctataaaaatgaaattaggtgataataagaacatgtactctattggatatatacatgacgaaattaaagatattataaaaagatataattttcatttgaaacatatagaaaaaggaaaagaatatataaaaaggataacacaagcaaataatattgcagacaaaatgaagaaagatgaacttataaaaaaaatttttgaatcctcaaaacattttgctagttttaaatatagcaatgaaatgataagcaaattagattcgttatttataaaaaatgaacaaatacttaataatttattcaataatatatttaatatattcaagaaaaaatatgaaacatatgtagatatgaaaacaattgaatctaaatatacaacagtaatgactctatcagaacatttattagaatatgcaatggatgttttaaaagctaaccctcaaaaacctattgatccaaaagcaaatctggattcagaagtagtaaaattacaaataaaaataaatgagaaatcaaatgaattagataatgctataagtcaagtaaacacactaataataataatgaaatcattttatgatattattatatctgaaaaagcctctatggatgaaatggaaaaaaaggaattatccttaaataattatattgaaaaaacagattatatattacaaacgtatggtatttttaagtctaaaagtaatattataaataataatagtaaaaatattagttctaaatatataattatagaagggttaaaaaatgatattgatgaattaaatagtcttatatcatattttaaggattcacaagaaacattaataaaagatgatgaattaaaaaaaaacatgaaaacggattatcttaataacgtgaaatatatagaagaaaatgttactcatataaatgaaattatattattaaaagattctataactcaacgaatagcagatattgatgaattaaatagtttaaatttaataaatataaatgattttataaatgaaaagaatatatcacaagagaaagtatcatataatcttaataaattatataaaggaagttttgaagaattagaatctgaactatctcattttttagacacaaaatatttgtttcatgaaaaaaaaagtgtaaatgaacttcaaacaattttaaatacatcaaataatgaatgtgctaaattaaattttatgaaatctgataataataataataataataataatagtaatataattaacttgttaaaaactgaattaagtcatctattaagtcttaaagaaaatataataaaaaaacttttaaatcatatagaacaaaatattcaaaactcatcaaataagtatactattacatatactgatattaataatagaatggaagattataaagaagaaatcgaaagtttagaagtatataaacataccattggaaatatacaaaaagaatatatattacatttatatgagaatgataaaaatgctttagctgtacataatacatcaatgcaaatattacaatataaagatgctatacaaaatataaaaaataaaatttctgatgatataaaaattttaaagaaatataaagaaatgaatcaagatttattaaattattatgaaattctagataaaaaattaaaagataatacatatatcaaagaaatgcatactgcttctttagttcaaataactcaatatattccttatgaagataaaacaataagtgaacttgagcaagaatttaataataataatcaaaaacttgataatatattacaagatatcaatgcaatgaatttaaatataaatattctccaaaccttaaatattggtataaatgcatgtaatacaaataataaaaatgtagaacacttacttaacaagaaaattgaattaaaaaatatattaaatgatcaaatgaaaattataaaaaatgatgatataattcaagataatgaaaaagaaaacttttcaaatgttttaaaaaaagaagaggaaaaattagaaaaagaattagatgatatcaaatttaataatttgaaaatggacattcataaattgttgaattcgtatgaccatacaaagcaaaatatagaaagcaatcttaaaataaatttagattctttcgaaaaggaaaaagatagttgggttcattttaaaagtactatagatagtttatatgtggaatataacatatgtaatcaaaagactcataatactatcaaacaacaaaaaaatgatatcatagaacttatttataaacgtataaaagatataaatcaagaaataatcgaaaaggtagataattattattccctgtcagataaagccttaactaaacttaaatctattcattttaatattgataaggaaaaatataaaaatcccaaaagtcaagaaaatattaaattattagaagatagagttatgatacttgagaaaaagattaaggaagataaagatgctttaatacaaattaagaatttatcacatgatcattttgtaaatgctgataatgagaaaaaaaagcagaaggagaaggaggaggacgacgaacaaacacactatagtaaaaaaagaaaagtaatgggagatatatataaggatattaaaaaaaacctagatgagttaaataataaaaatttgatagatattactttaaatgaagcaaataaaatagaatcagaatatgaaaaaatattaattgatgatatttgtgaacaaattacaaatgaagcaaaaaaaagtgatactattaaggaaaaaatcgaatcatataaaaaagatattgattatgtagatgtggacgtttccaaaacgaggaacgatcatcatttgaatggagataaaatacatgattcttttttttatgaagatacattaaattataaagcatattttgataaattaaaagatttatatgaaaatataaacaagttaacaaatgaatcaaatggattaaaaagtgatgctcataataacaacacacaagttgataaactaaaagaaattaatttacaagtattcagcaatttaggaaatataattaaatatgttgaaaaacttgagaatacattacatgaacttaaagatatgtacgaatttctagaaacgatcgatattaataaaatattaaaaagtattcataatagcatgaagaaatcagaagaatatagtaatgaaacgaaaaaaatatttgaacaatcagtaaatataactaatcaatttatagaagatgttgaaatattgaaaacgtctattaacccaaactatgaaagcttaaatgatgatcaaattgatgataatataaaatcacttgttctaaagaaagaggaaatatccgaaaaaagaaaacaagtgaataaatacataacagatattgaatctaataaagaacaatcagatttacatttacgatatacatctagaagtatatatgttattgatctttttataaaacatgaaataataaatcctagcgatggaaaaaattttgatattataaaggttaaagaaatgataaataaaaccaaacaagtttcaaatgaagctatggaatatgctaataaaatggatgaaaaaaataaggacattataaaaatagaaaatgaactttataatttaattaataataacatccgttcattaaaaggggtaaaatatgaaaaagttaggaaacaagcaagaaatgcaattgatgatataaataatatacattctaatattaaaacgattttaaccaaatctaaagaacgattagatgagattaagaaacaacctaacattaaaagagaaggtgatgttttaaataatgataaaaccaaaatagcttatattacaatacaaataaataacggaagaatagaatctaatttattaaatatattaaatatgaaacataacatagatactatcttgaataaagctatggattatatgaatgatgtatcaaaatctgaccagattgttattaatatagattctttgaatatgaacgatatatataataaggataaagatcttttaataaatattttaaaagaaaaacagaatatggaggcagaatataaaaaaatgaatgaaatgtataattacgttaatgaaacagaaaaagaaataataaaacataaaaaaaattatgaaataagaattatggaacatataaaaaaagaaacaaatgaaaaaaaaaaaaaatttatggaatctaataacaaatcattaactactttaatggattcattcagatctatgttttataatgaatatataaatgattataatataaatgaaaattttgaaaaacatcaaaatatattgaatgaaatatataatggatttaatgaatcatataatattattaatacaaaaatgactgaaattataaatgataatttagattataatgaaataaaagaaattaaagaagtagcacaaacagaatatgataaacttaataaaaaagttgatgaattaaaaaattatttgaataatattaaagaacaagaaggacatcgattaattgattatataaaagaaaaaatatttaacttatatataaaatgttcagaacaacaaaatataatagatgattcttataattatattacagttaaaaaacagtatattaaaactattgaagatgtgaaatttttattagattcattgaacacaatagaagaaaaaaataaatcagtagcaaatctagaaatttgtactagtaaagaagatataaaaaatttacttaaacatgttataaagttggcaaatttttcaggtattattgtaatgtctgatacaaatacggaaataactccagaaaatcctttagaagataatgatttattaaatttacaattatattttgaaagaaaacatgaaataacatcaacattggaaaatgattctgatttagagttagatcatttaggtagtaattcggatgaatctatagataatttaaaggtttataatgatattatagaattacacacatattcaacacaaattcttaaatatttagataatattcaaaaacttaaaggagattgcaatgatttagtaaaggattgtaaagaattacgtgaattgtctacggcattatatgatttaaaaatacaaattactagtgtaattaatagagaaaatgatatttcaaataatattgatattgtatctaataaattaaatgaaatagatgctatacaatataattttgaaaaatataaagaaatttttgataatgtagaagaatataaaacattagatgatacaaaaaatgcatatattgtaaaaaaggctgaaattttaaaaaatgtagatataaataaaacaaaagaagatttagatatatattttaatgacttagacgaattagaaaaatctcttacattatcatctaatgaaatggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggatgcatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgatgaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagagagagaaagaatagaaaaagaaaaacaagagaaagaaagactggaaagagagaaacaagaacaactacaaaaagaagaagaattaaaaagacaagagcaggaaaaacaacaacaaagaaatatccaagaattagaagagcaaaaaaagcctgaaataataaatgaagcattggtaaagggggataaaatactagaaggaagtgatcagagaaatatggaattaagcaaacctaacgttagtatggataatactaataatagtccaattagtaacagtgaaattacagaaagcgatgatattgataacagtgaaaatatacatactagtcatatgagtgacatcgaaagtacacaaactagtcatagaagtaacacccatgggcaacaaatcagtgatattgttgaagatcaaattacacatcctagtaatattggaggagaaaaaattactcataatgatgaaatttcaatcactggtgaaagaaataacattagcgatgttaatgattatagtgaaagtagcaacatatttgaaaatggtgacagtactataaataccagtacaagaaacacgtctagtacacatgatgaatcccatataagtcctatcagcaatgcgtatgatcatgttgtttcagataataaaaaaagtatggatgaaaacataaaagataaattaaagatagatgaaagtataactacagatgaacaaataagattagatgataattctaatattgttagaattgatagtactgaccaacgtgatgctagtagtcatggtagtagtaatagggatgatgatgaaataagtcatgttggtagcgacattcatatggatagtgttgatattcatgatagtattgacactgatgaaaatgctgatcacagacataatgttaactctgttgatagtcttagttctagtgattacactgatacacagaaagactttagtagtattattaaagatgggggaaataaagaaggacatgctgagaatgaatctaaagaatatgaatcccaaacagaacaaacacatgaagaaggaattatgaatccaaataaatattcaattagtgaagttgatggtattaaattaaatgaagaagctaaacataaaattacagaaaaactggtagatatctatccttctacatatagaacacttgatgaacctatggaaacacatggtccaaatgaaaaatttcatatgtttggtagtccatatgtaacagaagaagattacacggaaaaacatgattatgataagcatgaagatttcaataatgaaaggtattcaaaccataacaaaatggatgatttcgtatatactgctggaggagttgtttgttgtgtattattttttgcaagtattactttcttttctatggacagatcaaataaggatgaatgcgattttgatatgtgtgaagaagtatataataatgatcacttatcgaattatgctgataaagaagaaattattgaaattgtgtttgatgaaaatgaagaaaaatatttttaactattacatagtttaataatgaatatataagaaaaagacataatattattagataagtaattaattgttgttaatataattttttatcttgtttaaatatttataaaaaaaaaaaaaaaaaaagtgataataaatata

SEQ ID NO: 26 - DNA, 9995 bp, Plasmodium falciparum
  ref <308>: DATABASE ACCESSION NUMBER: Genbank accession no: AY138503
ctatttaaattatgaagaccacactattttgtagcatatctttttgtaatattatatttttcttcttaggtaaaataatatatacattcgaaaacaaattgtgctttgatgttgttcatattttaataattttgtatttttagatctttacaaaggctgtacaatgttctacgttgtgttagtctataatatttactactaaagcgtgtatatatatatatatatatatatatatatatatatatatatatatatatttatatatttatatatttatatttttatattttgtttcacattcagaattaagtcatgagcattttgttggacaatcaagtaatacccatggagcatcttcagttactgattttaattttagtgaggagaaaaatttaaaaagttttgaagggaagaataataataatgataattatgcttcaattaatcgtttatataggaagaaaccatatatgaagagatcgcttataaatttagaaaatgatctttttagattagaacctatatcttatattcaaagatattataagaagaatataaacagatctgatatttttcataataaaaaagaaagaggttccaaagtatattcaaatgtgtcttcattccattcttttattcaagagggtaaagaagaagttgaggttttttctatatggggtagtaatagcgttttagatcatatagatgttcttagggataatggaactgtcgttttttctgttcaaccatattaccttgatatatatacgtgtaaagaagccatattatttactacatcattttacaaggatcttgataaaagttcaattacaaaaattaatgaagatattgaaaaatttaacgaagaaataatcaagaatgaagaacaatgtttagttggtgggaaaacagattttgataatttacttatagttttagaaaatgcggaaaaagcaaatgttagaaaaacattatttgataatacatttaatgattataaaaataagaaatctagtttttacaattgtttgaaaaataaaaaaaatgattatgataagaaaataaataatataaagaatgagattacaaaattgttaaaaaatattgaaggtacaggaaaaatgtgtaaaacggaatcatatgttatgaataataatttatatctattaagagtgaatgaagttaaaagtacacctattgatttatacttaaatcgagcaaaagagctattagaatcaagtagcaaattagttaatcctataaaaatgaaattaggtgataataagaacatgtactctattggatatatacatgacgaaattaaagatattataaaaagatataattttcatttgaaacatatagaaaaaggaaaagaatatataaaaaggataacacaagcaaataatattgcagacaaaatgaagaaagatgaacttataaaaaaaatttttgaatcctcaaaacattttgctagttttaaatatagcaatgaaatgataagcaaattagattcgttatttataaaaaatgaacaaatacttaataatttattcaataatatatttaatatattcaagaaaaaatatgaaacatatgtagatatgaaaacaattgaatctaaatatacaacagtaatgactctatcagaacatttattagaatatgcaatggatgttttaaaagctaaccctcaaaaacctattgatccaaaagcaaatctggattcagaagtagtaaaattacaaataaaaataaatgagaaatcaaatgaattagataatgctataagtcaagtaaacacactaataataataatgaaatcattttatgatattattatatctgaaaaagcctctatggatgaaatggaaaaaaaggaattatccttaaataattatattgaaaaaacagattatatattacaaacgtatggtatttttaagtctaaaagtaatattataaataataatagtaaaaatattagttctaaatatataattatagaagggttaaaaaatgatattgatgaattaaatagtcttatatcatattttaaggattcacaagaaacattaataaaagatgatgaattaaaaaaaaacatgaaaacggattatcttaataacgtgaaatatatagaagaaaatgttactcatataaatgaaattatattattaaaagattctataactcaacgaatagcagatattgatgaattaaatagtttaaatttaataaatataaatgattttataaatgaaaagaatatatcacaagagaaagtatcatataatcttaataaattatataaaggaagttttgaagaattagaatctgaactatctcattttttagacacaaaatatttgtttcatgaaaaaaaaagtgtaaatgaacttcaaacaattttaaatacatcaaataatgaatgtgctaaattaaattttatgaaatctgataataataataataataataataatagtaatataattaacttgttaaaaactgaattaagtcatctattaagtcttaaagaaaatataataaaaaaacttttaaatcatatagaacaaaatattcaaaactcatcaaataagtatactattacatatactgatattaataatagaatggaagattataaagaagaaatcgaaagtttagaagtatataaacataccattggaaatatacaaaaagaatatatattacatttatatgagaatgataaaaatgctttagctgtacataatacatcaatgcaaatattacaatataaagatgctatacaaaatataaaaaataaaatttctgatgatataaaaattttaaagaaatataaagaaatgaatcaagatttattaaattattatgaaattctagataaaaaattaaaagataatacatatatcaaagaaatgcatactgcttctttagttcaaataactcaatatattccttatgaagataaaacaataagtgaacttgagcaagaatttaataataataatcaaaaacttgataatatattacaagatatcaatgcaatgaatttaaatataaatattctccaaaccttaaatattggtataaatgcatgtaatacaaataataaaaatgtagaacacttacttaacaagaaaattgaattaaaaaatatattaaatgatcaaatgaaaattataaaaaatgatgatataattcaagataatgaaaaagaaaacttttcaaatgttttaaaaaaagaagaggaaaaattagaaaaagaattagatgatatcaaatttaataatttgaaaatggacattcataaattgttgaattcgtatgaccatacaaagcaaaatatagaaagcaatcttaaaataaatttagattctttcgaaaaggaaaaagatagttgggttcattttaaaagtactatagatagtttatatgtggaatataacatatgtaatcaaaagactcataatactatcaaacaacaaaaaaatgatatcatagaacttatttataaacgtataaaagatataaatcaagaaataatcgaaaaggtagataattattattccctgtcagataaagccttaactaaacttaaatctattcattttaatattgataaggaaaaatataaaaatcccaaaagtcaagaaaatattaaattattagaagatagagttatgatacttgagaaaaagattaaggaagataaagatgctttaatacaaattaagaatttatcacatgatcattttgtaaatgctgataatgagaaaaaaaagcagaaggagaaggaggaggacgacgaacaaacacactatagtaaaaaaagaaaagtaatgggagatatatataaggatattaaaaaaaacctagatgagttaaataataaaaatttgatagatattactttaaatgaagcaaataaaatagaatcagaatatgaaaaaatattaattgatgatatttgtgaacaaattacaaatgaagcaaaaaaaagtgatactattaaggaaaaaatcgaatcatataaaaaagatattgattatgtagatgtggacgtttccaaaacgaggaacgatcatcatttgaatggagataaaatacatgattcttttttttatgaagatacattaaattataaagcatattttgataaattaaaagatttatatgaaaatataaacaagttaacaaatgaatcaaatggattaaaaagtgatgctcataataacaacacacaagttgataaactaaaagaaattaatttacaagtattcagcaatttaggaaatataattaaatatgttgaaaaacttgagaatacattacatgaacttaaagatatgtacgaatttctagaaacgatcgatattaataaaatattaaaaagtattcataatagcatgaagaaatcagaagaatatagtaatgaaacgaaaaaaatatttgaacaatcagtaaatataactaatcaatttatagaagatgttgaaatattgaaaacgtctattaacccaaactatgaaagcttaaatgatgatcaaattgatgataatataaaatcacttgttctaaagaaagaggaaatatccgaaaaaagaaaacaagtgaataaatacataacagatattgaatctaataaagaacaatcagatttacatttacgatatgcatctagaagtatatatgttattgatctttttataaaacatgaaataataaatcctagcgatggaaaaaattttgatattataaaggttaaagaaatgataaataaaaccaaacaagtttcaaatgaagctatggaatatgctaataaaatggatgaaaaaaataaggacattataaaaatagaaaatgaactttataatttaattaataataacatccgttcattaaaaggggtaaaatatgaaaaagttaggaaacaagcaagaaatgcaattgatgatataaataatatacattctaatattaaaacgattttaaccaaatctaaagaacgattagatgagattaagaaacaacctaacattaaaagagaaggtgatgttttaaataatgataaaaacaaaatagcttatattacaatacaaataaataacggaagaatagaatctaatttattaaatatattaaatatgaaacataacatagatactatcttgaataaagctatggattatatgaatgatgtatcaaaatctgaccagattgttattaatatagattctttgaatatgaacgatatatataataaggataaagatcttttaataaatattttaaaagaaaaacagaatatggaggcagaatataaaaaaatgaatgaaatgtataattacgttaatgaaacagaaaaagaaataataaaacataaaaaaaattatgaaataagaattatggaacatataaaaaaagaaacaaatgaaaaaaaaaaaaaatttatggaatctaataacaaatcattaactactttaatggattcattcagatctatgttttataatgaatatataaatgattataatataaatgaaaattttgaaaaacatcaaaatatattgaatgaaatatataatggatttaatgaatcatataatattattaatacaaaaatgactgaaattataaatgataatttagattataatgaaataaaagaaattaaagaagtagcacaaacagaatatgataaacttaataaaaaagttgatgaattaaaaaattatttgaataatattaaagaacaagaaggacatcgattaattgattatataaaagaaaaaatatttaacttatatataaaatgttcagaacaacaaaatataatagatgattcttataattatattacagttaaaaaacagtatattaaaactattgaagatgtgaaatttttattagattcattgaacacaatagaagaaaaaaataaatcagtagcaaatctagaaatttgtactagtaaagaagatataaaaaatttacttaaacatgttataaagttggcaaatttttcaggtattattgtaatgtctgatacaaatacggaaataactccagaaaatcctttagaagataatgatttattaaatttacaattatattttgaaagaaaacatgaaataacatcaacattggaaaatgattctgatttagagttagatcatttaggtagtaattcggatgaatctatagataatttaaaggtttataatgatattatagaattacacacatattcaacacaaattcttaaatatttagataatattcaaaaacttaaaggagattgcaatgatttagtaaaggattgtaaagaattacgtgaattgtctacggcattatatgatttaaaaatacaaattactagtgtaattaatagagaaaatgatatttcaaataatattgatattgtatctaataaattaaatgaaatagatgctatacaatataattttgaaaaatataaagaaatttttgataatgtagaagaatataaaacattagatgatacaaaaaatgcatatattgtaaaaaaggctgaaattttaaaaaatgtagatataaataaaacaaaagaagatttagatatatattttaatgacttagacgaattagaaaaatctcttacattatcatctaatgaaatggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggatgcatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgatgaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagagagagaaagaatagaaaaagaaaaacaagagaaagaaagactggaaagagagaaacaagaacaactacaaaaagaagaagaattaaaaagacaagagcaggaaaaacaacaacaaagaaatatccaagaattagaagagcaaaaaaagcctgaaataataaatgaagcattggtaaagggggataaaatactagaaggaagtgatcagagaaatatggaattaagcaaacctaacgttagtatggataatactaataatagtccaattagtaacagtgaaattacagaaagcgatgatattgataacagtgaaaatatacatactagtcatatgagtgacatcgaaagtacacaaactagtcatagaagtaacacccatgggcaacaaatcagtgatattgttgaagatcaaattacacatcctagtaatattggaggagaaaaaattactcataatgatgaaatttcaatcactggtgaaagaaataacattagcgatgttaatgattatagtgaaagtagcaacatatttgaaaatggtgacagtactataaataccagtacaagaaacacgtctagtacacatgatgaatcccatataagtcctatcagcaatgcgtatgatcatgttgtttcagataataaaaaaagtatggatgaaaacataaaagataaattaaagatagatgaaagtataactacagatgaacaaataagattagatgataattctaatattgttagaattgatagtactgaccaacgtgatgctagtagtcatggtagtagtaatagggatgatgatgaaataagtcatgttggtagcgacattcatatggatagtgttgatattcatgatagtattgacactgatgaaaatgctgatcacagacataatgttaactctgttgatagtcttagttctagtgattacactgatacacagaaagactttagtagtattattaaagatgggggaaataaagaaggacatgctgagaatgaatctaaagaatatgaatcccaaacagaacaaacacatgaagaaggaattatgaatccaaataaatattcaattagtgaagttgatggtattaaattaaatgaagaagctaaacataaaattacagaaaaactggtagatatctatccttctacatatagaacacttgatgaacctatggaaacacatggtccaaatgaaaaatttcatatgtttggtagtccatatgtaacagaagaagattacacggaaaaacatgattatgataagcatgaagatttcaataatgaaaggtattcaaaccataacaaaatggatgatttcgtatatactgctggaggagttgtttgttgtgtattattttttgcaagtattactttcttttctatggacagatcaaataaggatgaatgcgattttgatatgtgtgaagaagtatataataatgatcacttatcgaattatgctgataaagaagaaattattgaaattgtgtttgatgaaaatgaagaaaaatatttttaactattacatagtttaataatgaatatataagaaaaagacataatattattagataagtaattaattgttgttaatataattttttatcttgtttaaatatttataaaaaaaaaaaaaaaaaaagtgataataaatata

SEQ ID NO: 27 - DNA, 9886 bp, Plasmodium falciparum
  ref <308>: DATABASE ACCESSION NUMBER: Genbank accession no: AY138496
tatatatatcgtttctttttcgtgttattaaaatttgaaagtatatatatactaaagctgtaatattattaaatttaattcgttaatatatatatatattattaagtatagtatagtattgaaatatataatcatatatattcttataacataaaatgcttggttttttttttttttttttaattatttataaaagcatgagattatagtatagctatttaaattatgaagaccacactattttgtagcatatctttttgtaatattatatttttcttcttaggtaaaataatatatacattcgaaaacaaattgtgctttgatgttgttcatattttaataattttgtatttttagatctttacaaaggctgtacaatgttctacgttgtgttagtctataatatttactactaaagcgtgtatatatatatatatatatatatatatatttatatatttatatatttatatttttatattttgtttcacattcagaattaagtcatgagcattttgttggacaatcaagtaatacccatggagcatcttcagttactgattttaattttagtgaggagaaaaatttaaaaagttttgaagggaagaataataataatgataattatgcttcaattaatcgtttatataggaagaaaccatatatgaagagatcgcttataaatttagaaaatgatctttttagattagaacctatatcttatattcaaagatattataagaagaatataaacagatctgatatttttcataataaaaaagaaagaggttccaaagtatattcaaatgtgtcttcattccattcttttattcaagagggtaaagaagaagttgaggttttttctatatggggtagtaatagcgttttagatcatatagatgttcttagggataatggaactgtcgttttttctgttcaaccatattaccttgatatatatacgtgtaaagaagccatattatttactacatcattttacaaggatcttgataaaagttcaattacaaaaattaatgaagatattgaaaaatttaacgaagaaataatcaagaatgaagaacaatgtttagttggtgggaaaacagattttgataatttacttatagttttagaaaatgcggaaaaagcaaatgttagaaaaacattatttgataatacatttaatgattataaaaataagaaatctagtttttacaattgtttgaaaaataaaaaaaatgattatgataagaaaataaagaatataaagaatgagattacaaaattgttaaaaaatattgaaagtacaggaaatatgtgtaaaacggaatcatatgttatgaataataatttatatctattaagagtgaatgaagttaaaagtacacctattgatttatacttaaatcgagcaaaagagctattagaatcaagtagcaaattagttaatcctataaaaatgaaattaggtgataataagaacatgtactctattggatatatacatgacgaaattaaagatattataaaaagatataattttcatttgaaacatatagaaaaaggaaaagaatatataaaaaggataacacaagcaaataatattgcagacaaaatgaagaaagatgaacttataaaaaaaatttttgaatcctcaaaacattttgctagttttaaatatagcaatgaaatgataagcaaattagattcgttatttataaaaaatgaagaaatacttaataatttattcaataatatatttaatatattcaagaaaaaatatgaaacatatgtagatatgaaaacaattgaatctaaatatacaacagtaatgactctatcagaacatttattagaatatgcaatggatgttttaaaagctaaccctcaaaaacctattgatccaaaagcaaatctggattcagaagtagtaaaattacaaataaaaataaatgagaaatcaaatgaattagataatgctataagtcaagtaaaaacactaataataataatgaaatcattttatgatattattatatctgaaaaagcctctatggatgaaatggaaaaaaaggaattatccttaaataattatattgaaaaaacagattatatattacaaacgtataatatttttaagtctaaaagtaatattataaataataatagtaaaaatattagttctaaatatataactatagaagggttaaaaaatgatattgatgaattaaatagtcttatatcatattttaaggattcacaagaaacattaataaaagatgatgaattaaaaaaaaacatgaaaacggattatcttaataacgtgaaatatatagaagaaaatgttactcatataaatgaaattatattattaaaagattctataactcaacgaatagcagatattgatgaattaaatagtttaaatttaataaatataaatgattttataaatgaaaagaatatatcacaagagaaagtatcatataatcttaataaattatataaaggaagttttgaagaattagaatctgaactatctcattttttagacacaaaatatttgtttcatgaaaaaaaaagtgtaaatgaacttcaaacaattttaaatacatcaaataatgaatgtgctaaattaaattttatgaaatctgataataataataataataataatagtaatataattaacttgttaaaaactgaattaagtcatctattaagtcttaaagaaaatataataaaaaaacttttaaatcatatagaacaaaatattcaaaactcatcaaataagtatactattacatatactgatattaataatagaatggaagattataaagaagaaatcgaaagtttagaagtatataaacataccattggaaatatacaaaaagaatatatattacatttatatgagaatgataaaaatgctttagctgtacataatacatcaatgcaaatattacaatataaagatgctatacaaaatataaaaaataaaatttctgatgatataaaaattttaaagaaatataaagaaatgaatcaagatttattaaattattatgaaattctagataaaaaattaaaagataatacatatatcaaagaaatgcatactgcttctttagttcaaataactcaatatattccttatgaagataaaacaataagtgaacttgagcaagaatttaataataataatcaaaaacttgataatatattacaagatatcaatgcaatgaatttaaatataaatattctccaaaccttaaatattggtataaatgcatgtaatacaaataataaaaatgtagaacacttacttaacaagaaaattgaattaaaaaatatattaaatgatcaaatgaaaattataaaaaatgatgatataattcaagataatgaaaaagaaaacttttcaaatgttttaaaaaaagaagaggaaaaattagaaaaagaattagatgatatcaaatttaataatttgaaaatggacattcataaattgttgaattcgtatgaccatacaaagcaaaatatagaaagcaatcttaaaataaatttagattctttcgaaaaggaaaaagatagttgggttcattttaaaagtactatagatagtttatatgtggaatataacatatgtaatcaaaagactcataatactatcaaacaacaaaaaaatgatatcatagaacttatttataaacgtataaaagatataaatcaagaaataatcgaaaaggtagataattattattccctgtcagataaagccttaactaaacttaaatctattcattttaatattgataaggaaaaatataaaaatcccaaaagtcaagaaaatattaaattattagaagatagagttatgatacttgagaaaaagattaaggaagataaagatgctttaatacaaattaagaatttatcacatgatcattttgtaaatgctgataatgagaaaaaaaagcagaaggagaaggaggaggacgacgaacaaacacactatagtaaaaaaagaaaagtaatgggagatatatataaggatattaaaaaaaacctagatgagttaaataataaaaatttgatagatattactttaaatgaagcaaataaaatagaatcagaatatgaaaaaatattaattgatgatatttgtgaacaaattacaaatgaagcaaaaaaaagtgatactattaaggaaaaaatcgaatcatataaaaaagatattgattatgtagatgtggacgtttccaaaacgaggaacgatcatcatttgaatggagataaaatacatgattcttttttttatgaagatacattaaattataaagcatattttgataaattaaaagatttatatgaaaatataaacaagttaacaaatgaatcaaatggattaaaaagtgatgctcataataacaacacacaagttgataaactaaaagaaattaatttacaagtattcagcaatttaggaaatataattaaatatgttgaaaaacttgagaatacattacatgaacttaaagatatgtacgaatttctagaaacgatcgatattaataaaatattaaaaagtattcataatagcatgaagaaatcagaagaatatagtaatgaaacgaaaaaaatatttgaacaatcagtaaatataactaatcaatttatagaagatgttgaaatattgaaaacgtctattaacccaaactatgaaagcttaaatgatgatcaaattgatgataatataaaatcacttgttctaaagaaagaggaaatatccgaaaaaagaaaacaagtgaataaatacataacagatattgaatctaataaagaacaatcagatttacatttacgatatgcatctagaagtatatatgttattgatctttttataaaacatgaaataataaatcctagcgatggaaaaaattttgatattataaaggttaaagaaatgataaataaaaccaaacaagtttcaaatgaagctatggaatatgctaataaaatggatgaaaaaaataaggacattataaaaatagaaaatgaactttataatttaattaataataacatccgttcattaaaaggggtaaaatatgaaaaagttaggaaacaagcaagaaatgcaattgatgatataaataatatacattctaatattaaaacgattttaaccaaatctaaagaacgattagatgagattaagaaacaacctaacattaaaagagaaggtgatgttttaaataatgataaaaccaaaatagcttatattacaatacaaataaataacggaagaatagaatctaatttattaaatatattaaatatgaaacataacatagatactatcttgaataaagctatggattatatgaatgatgtatcaaaatctgaccagattgttattaatatagattctttgaatatgaacgatatatataataaggataaagatcttttaataaatattttaaaagaaaaacagaatatggaggcagaatataaaaaaatgaatgaaatgtataattacgttaatgaaacagaaaaagaaataataaaacataaaaaaaattatgaaataagaattatggaacatataaaaaaagaaacaaatgaaaaaaaaaaaaaatttatggaatctaataacaaatcattaactactttaatggattcattcagatctatgttttataatgaatatataaatgattataatataaatgaaaattttgaaaaacatcaaaatatattgaatgaaatatataatggatttaatgaatcatataatattattaatacaaaaatgactgaaattataaatgataatttagattataatgaaataaaagaaattaaagaagtagcacaaacagaatatgataaacttaataaaaaagttgatgaattaaaaaattatttgaataatattaaagaacaagaaggacatcgattaattgattatataaaagaaaaaatatttaacttatatataaaatgttcagaacaacaaaatataatagatgattcttataattatattacagttaaaaaacagtatattaaaactattgaagatgtgaaatttttattagattcattgaacacaatagaagaaaaaaataaatcagtagcaaatctagaaatttgtactaataaagaagatataaaaaatttacttaaacatgttataaagttggcaaatttttcaggtattattgtaatgtctgatacaaatacggaaataactccagaaaatcctttagaagataatgatttattaaatttacaattatattttgaaagaaaacatgaaataacatcaacattggaaaatgattctgatttagagttagatcatttaggtagtaattcggatgaatctatagataatttaaaggtttataatgatattatagaattacacacatattcaacacaaattcttaaatatttagataatattcaaaaacttaaaggagattgcaatgatttagtaaaggattgtaaagaattacgtgaattgtctacggcattatatgatttaaaaatacaaattactagtgtaattaatagagaaaatgatatttcaaataatattgatattgtatctaataaattaaatgaaatagatgctatacaatataattttgaaaaatataaagaaatttttgataatgtagaagaatataaaacattagatgatacaaaaaatgcatatattgtaaaaaaggctgaaattttaaaaaatgtagatataaataaaacaaaagaagatttagatatatattttaatgacttagacgaattagaaaaatctcttacattatcatctaatgaaatggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggctgcatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgatgaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagagagagaaagaatagaaaaagaaaaacaagagaaagaaagactggaaagagagaaacaagaacaactaaaaaaagaagaagaattaagaaaaaaagagcaggaaagacaagaacaacaacaaaaagaagaagcattaaaaagacaagaacaagaacgactacaaaaagaagaagaattaaaaagacaagagcaagaaaggctggaaagagagaaacaagaacaactacaaaaagaagaagaattaaaaagacaagaacaagaacgactacaaaaagaagaagcattaaaaagacaagaacaagaacgactacaaaaagaagaagaattaaaaagacaagagcaagaaaggctggaaagagagaaacaagaacaactacaaaaagaagaagaattaaaaagacaagaacaagaacgactacaaaaagaagaagcattaaaaagacaagaacaagaacgactacaaaaagaagaagaattaaaaagacaagagcaagaaagactggaaagaaagaaaatcgagttagcagaaagagaacaacacataaaaagtaaactagaatctgatatggtgaaaataataaaggatgaactaacaaaagaaaaagatgaaataataaaaaacaaagatataaaacttagacatagtttggaacagaaatggttaaaacatttacaaaatatattatcgttaaaaatagatagtctattaaataaaaatgatgaggtcataaaagataatgagacacaattgaaaacaaatatattgaactcattaaaaaatcaattatatcttaatttgaaacgtgaacttaatgaaattataaaggaatacgaagaaaaccagaaaaaaatattgcattcaaatcaacttgttaacgatagtttagagcaaaaaactaatagactcgtcgatattaaacctacaaagcatggtgatatatatactaataaactttctgataatgaaactgaaatgctgataacatctaaagaaaaaaaagatgaaacagaatcaactaaaagatcaggaacagatcatactaatagttcggaaagtactactgatgataataccaatgatagaaatttttctcgatcaaagaatttgagtgttgctatatacacagcaggaagtgtagctttatgtgtgttaatattttctagtataggattattacttataaagactaatagtggagataacaattctaatgaaattaatgaagcttttgaaccgaatgatgatgttctctttaaggagaaggatgaaatcattgaaatcacttttaatgataatgatagtacaatttaaaatgtatgagataacatattatgtatagaaaatatgataacatgtgagaaaata

SEQ ID NO: 28 - DNA, 9781 bp, Plasmodium falciparum
  ref <308>: DATABASE ACCESSION NUMBER: Genbank accession no: AY138497
tatatatatcgtttctttttcgtgttattaaaatttgaaagtatatatatactaaagctgtaatattattaaatttaattcgttaatatatatatatattattaagtatagtatagtattgaaatatataatcatatatattcttataacataaaatgcttggtttttttttttttttttttaattatttataaaagcatgagattatagtatagctatttaaattatgaagaccacactattttgtagcatatctttttgtaatattatatttttcttcttaggtaaaataatatatacattcgaaaacaaattgtgctttgatgttgttcatattttaataattttgtatttttagatctttacaaaggctgtacaatgttctacgttgtgttagtctataatatttactactaaagcgtgtatatatatatatatatatatatatttatatatttatatatttatatttttatattttgtttcacattcagaattaagtcatgagcattttgttggacaatcaagtaatacccatggagcatcttcagttactgattttaattttagtgaggagaaaaatttaaaaagttttgaagggaagaataataataatgataattatgcttcaattaatcgtttatataggaagaaaccatatatgaagagatcgcttataaatttagaaaatgatctttttagattagaacctatatcttatattcaaagatattataagaagaatataaacagatctgatatttttcataataaaaaagaaagaggttccaaagtatattcaaatgtgtcttcattccattcttttattcaagagggtaaagaagaagttgaggttttttctatatggggtagtaatagcgttttagatcatatagatgttcttagggataatggaactgtcgttttttctgttcaaccatattaccttgatatatatacgtgtaaagaagccatattatttactacatcattttacaaggatcttgataaaagttcaattacaaaaattaatgaagatattgaaaaatttaacgaagaaataatcaagaatgaagaacaatgtttagttggtgggaaaacagattttgataatttacttatagttttagaaaatgcggaaaaagcaaatgttagaaaaacattatttgataataaatttaaagattataaaaataagaaatctagtttttacaattgtttgaaaaataaaaaaaatgattatgataagaaaataaataatataaagaatgagattacaaaattgttaaaaaatattgaaggtacaggaaaaatgtgtaaaacggaatcatatgttatgaataataatttatatctattaagagtgaatgaagttaaaagtacacctattgatttatacttaaatcgagcaaaagagctattagaatcaagtagcaaattagttaatcctataaaaatgaaattaggtgataataagaacatgtactctattggatatatacatgacgaaattaaagatattataaaaagatataattttcatttgaaacatatagaaaaaggaaaagaatatataaaaaggataacacaagcaaataatattgcagacaaaatgaagaaagatgaacttataaaaaaaatttttgaatcctcaaaacattttgctagttttaaatatagcaatgaaatgataagcaaattagattcgttatttataaaaaatgaacaaatacttaataatttattcaataatatatttaatatattcaagaaaaaatatgaaacatatgtagatatgaaaacaattgaatctaaatatacaacagtaatgactctatcagaacatttattagaatatgcaatggatgttttaaaagctaaccctcaaaaacctattgatccaaaagcaaatctggattcagaagtagtaaaattacaaataaaaataaatgagaaatcaaatgaattagataatgctataagtcaagtaaacacactaataataataatgaaatcattttatgatattattatatctgaaaaagcctctatggatgaaatggaaaaaaaggaattatccttaaataattatattgaaaaaacagattatatattacaaacgtatgatatttttaagtctaaaagtaatattataaataataatagtaaaaatattagttctaaatatataattatagaagggttaaaaaattatattgatgaattaaatagtcttatatcagattttaaggattcacaagaaacattaataaaagatgatgaattaaaaaaaaacatgaaaacggattatcttaataacgtgaaatatatagaagaaaatgttactcatataaatgaaattatattattaaaacattctataaatcaacgaatagcagatattgatgaattaaatagtttaaatttaataaatataaatgattttataaatgaaaagaatatatcacaagagaaagtatcatataatcttaataaattatataaaggaagttttgaagaattagaatctgaactatctcattttttagacacaaaatatttgtttcatgaaaaaaaaagtgtaaatgaacttcaaacaattttaaatacatcaaataatgaatgtgctaaattaaattttatgaaatctgataataataataataataataataataatagtaatataattaacttgttaaaaactgaattaagtcatctattaagtcttaaagaaaatataataaaaaaacttttaaatcatatagaacaaaatattcaaaactcatcaaataagtatactattacatatactgatattaataatagaatggaagattataaagaagaaatcgaaagtttagaagtatataaacataccattggaaatatacaaaaagaatatatattacatttatatgagaatgataaaaatgctttagctgtacataatacatcaatgcaaatattacaatataaagatgctatacaaaatataaaaaataaaatttctgatgatataaaaattttaaagaaatataaagaaatgaatcaagatttattaaattattatgaaattctagataaaaaattaaaagataatacatatatcaaagaaatgcatactgcttctttagttcaaataactcaatatattccttatgaagataaaacaataagtgaacttgagcaagaatttaataataataatcaaaaacttgataatatattacaagatatcaatgcaatgaatttaaatataaatattctccaaaccttaaatattggtataaatgcatgtaatacaaataataaaaatgtagaacacttacttaacaagaaaattgaattaaaaaatatattaaatgatcaaatgaaaattataaaaaatgatgatataattcaagataatgaaaaagaaaacttttcaaatgttttaaaaaaagaagaggaaaaattagaaaaagaattagatgatatcaaatttaataatttgaaaatggacattcataaattgttgaattcgtatgaccatacaaagcaaaatatagaaagcaatcttaaaataaatttagattctttcgaaaaggaaaaagatagttgggttcattttaaaagtactatagatagtttatatgtggaatataacatatgtaatcaaaagactcataatactatcaaacaacaaaaaaatgatatcatagaacttatttataaacgtataaaagatataaatcaagaaataatcgaaaaggtagataattattattccctgtcagataaagccttaactaaacttaaatctattcattttaatattgataaggaaaaatataaaaatcccaaaagtcaagaaaatattaaattattagaagatagagttatgatacttgagaaaaagattaaggaagataaagatgctttaatacaaattaagaatttatcacatgatcattttgtaaatgctgataatgagaaaaaaaagcagaaggagaaggaggaggacgacgaacaaacacactatagtaaaaaaagaaaagtaatgggagatatatataaggatattaaaaaaaacctagatgagttaaataataaaaatttgatagatattactttaaatgaagcaaataaaatagaatcagaatatgaaaaaatattaattgatgatatttgtgaacaaattacaaatgaagcaaaaaaaagtgatactattaaggaaaaaatcgaatcatataaaaaagatattgattatgtagatgtggacgtttccaaaacgaggaacgatcatcatttgaatggagataaaatacatgattcttttttttatgaagatacattaaattataaagcatattttgataaattaaaagatttatatgaaaatataaacaagttaacaaatgaatcaaatggattaaaaagtgatgctcataataacaacacacaagttgataaactaaaagaaattaatttacaagtattcagcaatttaggaaatataattaaatatgttgaaaaacttgagaatacattacatgaacttaaagatatgtacgaatttctagaaacgatcgatattaataaaatattaaaaagtattcataatagcatgaagaaatcagaagaatatagtaatgaaacgaaaaaaatatttgaacaatcagtaaatataactaatcaatttatagaagatgttgaaatattgaaaacgtctattaacccaaactatgaaagcttaaatgatgatcaaattgatgataatataaaatcacttgttctaaagaaagaggaaatatccgaaaaaagaaaacaagtgaataaatacataacagatattgaatctaataaagaacaatcagatttacatttacgatatgcatctagaagtatatatgttattgatctttttataaaacatgaaataataaatcctagcgatggaaaaaattttgatattataaaggttaaagaaatgataaataaaaccaaacaagtttcaaatgaagctatggaatatgctaataaaatggatgaaaaaaataaggacattataaaaatagaaaatgaactttataatttaattaataataacatccgttcattaaaaggggtaaaatatgaaaaagttaggaaacaagcaagaaatgcaattgatgatataaataatatacattctaatattaaaacgattttaaccaaatctaaagaacgattagatgagattaagaaacaacctaacattaaaagagaaggtgatgttttaaataatgataaaaccaaaatagcttatattacaatacaaataaataacggaagaatagaatctaatttattaaatatattaaatatgaaacataacatagatactatcttgaataaagctatggattatatgaatgatgtatcaaaatctgaccagattgttattaatatagattctttgaatatgaacgatatatataataaggataaagatcttttaataaatattttaaaagaaaaacagaatatggaggcagaatataaaaaaatgaatgaaatgtataattacgttaatgaaacagaaaaagaaataataaaacataaaaaaaattatgaaataagaattatggaacatataaaaaaagaaacaaatgaaaaaaaaaaaaaatttatggaatctaataacaaatcattaactactttaatggattcattcagatctatgttttataatgaatatataaatgattataatataaatgaaaattttgaaaaacatcaaaatatattgaatgaaatatataatggatttaatgaatcatataatattattaatacaaaaatgactgaaattataaatgataatttagattataatgaaataaaagaaattaaagaagtagcacaaacagaatatgataaacttaataaaaaagttgatgaattaaaaaattatttgaataatattaaagaacaagaaggacatcgattaattgattatataaaagaaaaaatatttaacttatatataaaatgttcagaacaacaaaatataatagatgattcttataattatattacagttaaaaaacagtatattaaaactattgaagatgtgaaatttttattagattcattgaacacaatagaagaaaaaaataaatcagtagcaaatctagaaatttgtactaataaagaagatataaaaaatttacttaaacatgttataaagttggcaaatttttcaggtattattgtaatgtctgatacaaatacggaaataactccagaaaatcctttagaagataatgatttattaaatttacaattatattttgaaagaaaacatgaaataacatcaacattggaaaatgattctgatttagagttagatcatttaggtagtaattcggatgaatctatagataatttaaaggtttataatgatattatagaattacacacatattcaacacaaattcttaaatatttagataatattcaaaaacttaaaggagattgcaatgatttagtaaaggattgtaaagaattacgtgaattgtctacggcattatatgatttaaaaatacaaattactagtgtaattaatagagaaaatgatatttcaaataatattgatattgtatctaataaattaaatgaaataaatgctatacaatataattttgaaaaatataaagaaatttttgataatgtagaagaatataaaacattagatgatacaaaaaatgcatatattgtaaaaaaggctgaaattttaaaaaatgtagatataaataaaacaaaagaagatttagatatatattttaatgacttagacgaattagaaaaatctcttacattatcatctaatgaaatggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggatgcatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgatgaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagaaagagaaagattggaaaaagcgaaacaagaagaagaaagaaaagagagagaaagaatagaaaaagaaaaacaagagaaagaaagactggaaagagagaaacaagaacaactaaaaaaagaagcattaaaaaaacaagagcaagaaagacaagaacaacaacaaaaagaagaagcattaaaaagacaagaacaagaacgactacaaaaagaagaagaattaaaaagacaagagcaagaaaggctggaaagagagaaacaagaacaactacaaaaagaagaagaattaaaaagacaagaacaagaacgactacaaaaagaagaagcattaaaaagacaagaacaagaacgactacaaaaagaagaagaattaaaaagacaagagcaagaaagactggaaagaaagaaaatcgagttagcagaaagagaacaacacataaaaagtaaactagaatctgatatggtgaaaataataaaggatgaactaacaaaagaaaaagatgaaataataaaaaacaaagatataaaacttagacatagtttggaacagaaatggttaaaacatttacaaaatatattatcgttaaaaatagatagtctattaaataaaaatgatgaggtcataaaagataatgagacacaattgaaaacaaatatattgaactcattaaaaaatcaattatatcttaatttgaaacgtgaacttaatgaaattataaaggaatacgaagaaaaccagaaaaaaatattgcattcaaatcaacttgttaacgatagtttagagcaaaaaactaatagactcgtcgatattaaacctacaaagcatggtgatatatatactaataaactttctgataatgaaactgaaatgctgataacatctaaagaaaaaaaagatgaaacagaatcaactaaaagatcaggaacagatcatactaatagttcggaaagtactactgatgataataccaatgatagaaatttttctcgatcaaagaatttgagtgttgctatatacacagcaggaagtgtagctttatgtgtgttaatattttctagtataggattattacttataaagactaatagtggagataacaattctaatgaaattaatgaagcttttgaaccgaatgatgatgttctctttaaggagaaggatgaaatcattgaaatcacttttaatgataatgatagtacaatttaaaatgtatgagataacatattatgtatagaaaatatgataacatgtgagaaaata

SEQ ID NO: 29 - DNA, 9744 bp, Plasmodium falciparum
  ref <308>: DATABASE ACCESSION NUMBER: Genbank accession no: AY138498
tatatatatcgtttctttttcgtgttattaaaatttgaaagtatatatatactaaagctgtaatattattaaatttaattcgttaatatatatatatattattaagtatagtatagtattgaaatatataatcatatatattcttataacataaaatgcttggtttttttttttttttttttaattatttataaaagcatgagattatagtatagctatttaaattatgaagatcacactattttgtagcatatctttttgtaatattatatttttcttcttaggtaaaataatatatacattcgaaaacaaattgtgctttgatgttgttcatattttaataattttgtatttttagatctttacaaaggctgtacaatgttctacgttgtgttagtctataatatttactactaaagcgtgtatatatatatatatatatatatatatatatatttatatatttatatatttatatttttatattttgtttcacattcagaattaagtcatgagcattttgttggacaatcaagtaatacccatggagcatcttcagttactgattttaattttagtgaggagaaaaatttaaaaagttttgaagggaagaataataataatgataattatgcttcaattaatcgtttatataggaagaaaccatatatgaagagatcgcttataaatttagaaaatgatctttttagattagaacctatatcttatattcaaagatattataagaagaatataaacagatctgatatttttcataataaaaaagaaagaggttccaaagtatattcaaatgtgtcttcattccattcttttattcaagagggtaaagaagaagttgaggttttttctatatggggtagtaatagcgttttagatcatatagatgttcttagggataatggaactgtcgttttttctgttcaaccatattaccttgatatatatacgtgtaaagaagccatattatttactacatcattttacaaggatcttgataaaagttcaattacaaaaattaatgaagatattgaaaaatttaacgaagaaataatcaagaatgaagaacaatgtttagttggtgggaaaacagattttgataatttacttatagttttagaaaatgcggaaaaagcaaatgttagaaaaacattatttgataataaatttaatgattataaaaataagaaatctagtttttacaattgtttgaaaaataaaaaaaatgattatgataagaaaataaataatataaagaatgagattacaaaattgttaaaaaatattgaaagtacaggaaatatgtgtaaaacggaatcatatgttatgaataataatttatatctattaagagtgaatgaagttaaaagtacacctattgatttatacttaaatcgagcaaaagagctattagaatcaagtagcaaattagttaatcctataaaaatgaaattaggtgataataagaacatgtactctattggatatatacatgacgaaattaaagatattataaaaagatataattttcatttgaaacatatagaaaaaggaaaagaatatataaaaaggataacacaagcaaataatattgcagacaaaatgaagaaagatgaacttataaaaaaaatttttgaatcctcaaaacattttgctagttttaaatatagcaatgaaatgataagcaaattagattcgttatttataaaaaatgaacaaatacttaataatttattcaataatatatttaatatattcaagaaaaaatatgaaacatatgtagatatgaaaacaattgaatctaaatatacaacagtaatgactctatcagaacatttattagaatatgcaatggatgttttaaaagctaaccctcaaaaacctattgatccaaaagcaaatctggattcagaagtagtaaaattacaaataaaaataaatgagaaatcaaatgaattagataatgctataagtcaagtaaacacactaataataataatgaaatcattttatgatattattatatctgaaaaagcctctatggatgaaatggaaaaaaaggaattatccttaaataattatattgaaaaaacagattatatattacaaacgtatggtatttttaagtctaaaagtaatattataaataataatagtaaaaatattagttctaaatatataattatagaagggttaaaaaatgatattgatgaattaaatagtcttatatcatattttaaggattcacaagaaacattaataaaagatgatgaattaaaaaaaaacatgaaaacggattatcttaataacgtgaaatatatagaagaaaatgttactcatataaatgaaattatattattaaaagattctataactcaacgaatagcagatattgatgaattaaatagtttaaatttaataaatataaatgattttataaatgaaaagaatatatcacaagagaaagtatcatataatcttaataaattatataaaggaagttttgaagaattagaatctgaactatctcattttttagacacaaaatatttgtttcatgaaaaaaaaagtgtaaatgaacttcaaacaattttaaatacatcaaataatgaatgtgctaaattaaattttatgaaatctgataataataataataataataataatagtaatataattaacttgttaaaaactgaattaagtcatctattaagtcttaaagaaaatataataaaaaaacttttaaatcatatagaacaaaatattcaaaactcatcaaataagtatactattacatatactgatattaataatagaatggaagattataaagaagaaatcgaaagtttagaagtatataaacataccattggaaatatacaaaaagaatatatattacatttatatgagaatgataaaaatgctttagctgtacataatacatcaatgcaaatattacaatataaagatgctatacaaaatataaaaaataaaatttctgatgatataaaaattttaaagaaatataaagaaatgaatcaagatttattaaattattatgaaattctagataaaaaattaaaagataatacatatatcaaagaaatgcatactgcttctttagttcaaataactcaatatattccttatgaagataaaacaataagtgaacttgagcaagaatttaataataataatcaaaaacttgataatatattacaagatatcaatgcaatgaatttaaatataaatattctccaaaccttaaatattggtataaatgcatgtaatacaaataataaaaatgtagaacacttacttaacaagaaaattgaattaaaaaatatattaaatgatcaaatgaaaattataaaaaatgatgatataattcaagataatgaaaaagaaaacttttcaaatgttttaaaaaaagaagaggaaaaattagaaaaagaattagatgatatcaaatttaataatttgaaaatggacattcataaattgttgaattcgtatgaccatacaaagcaaaatatagaaagcaatcttaaaataaatttagattctttcgaaaaggaaaaagatagttgggttcattttaaaagtactatagatagtttatatgtggaatataacatatgtaatcaaaagactcataatactatcaaacaacaaaaaaatgatatcatagaacttatttataaacgtataaaagatataaatcaagaaataatcgaaaaggtagataattattattccctgtcagataaagccttaactaaacttaaatctattcattttaatattgataaggaaaaatataaaaatcccaaaagtcaagaaaatattaaattattagaagatagagttatgatacttgagaaaaagattaaggaagataaagatgctttaatacaaattaagaatttatcacatgatcattttgtaaatgctgataatgagaaaaaaaagcagaaggagaaggaggaggacgacgaacaaacacactatagtaaaaaaagaaaagtaatgggagatatatataaggatattaaaaaaaacctagatgagttaaataataaaaatttgatagatattactttaaatgaagcaaataaaatagaatcagaatatgaaaaaatattaattgatgatatttgtgaacaaattacaaatgaagcaaaaaaaagtgatactattaaggaaaaaatcgaatcatataaaaaagatattgattatgtagatgtggacgtttccaaaacgaggaacgatcatcatttgaatggagataaaatacatgattcttttttttatgaagatacattaaattataaagcatattttgataaattaaaagatttatatgaaaatataaacaagttaacaaatgaatcaaatggattaaaaagtgatgctcataataacaacacacaagttgataaactaaaagaaattaatttacaagtattcagcaatttaggaaatataattaaatatgttgaaaaacttgagaatacattacatgaacttaaagatatgtacgaatttctagaaacgatcgatattaataaaatattaaaaagtattcataatagcatgaagaaatcagaagaatatagtaatgaaacgaaaaaaatatttgaacaatcagtaaatataactaatcaatttatagaagatgttgaaatattgaaaacgtctattaacccaaactatgaaagcttaaatgatgatcaaattgatgataatataaaatcacttgttctaaagaaagaggaaatatccgaaaaaagaaaacaagtgaataaatacataacagatattgaatctaataaagaacaatcagatttacatttacgatatacatctagaagtatatatgttattgatctttttataaaacatgaaataataaatcctagcgatggaaaaaattttgatattataaaggttaaagaaatgataaataaaaccaaacaagtttcaaatgaagctatggaatatgctaataaaatggatgaaaaaaataaggacattataaaaatagaaaatgaactttataatttaattaataataacatccgttcattaaaaggggtaaaatatgaaaaagttaggaaacaagcaagaaatgcaattgatgatataaataatatacattctaatattaaaacgattttaaccaaatctaaagaacgattagatgagattaagaaacaacctaacattaaaagagaaggtgatgttttaaataatgataaaaccaaaatagcttatattacaatacaaataaataacggaagaatagaatctaatttattaaatatattaaatatgaaacataacatagatactatcttgaataaagctatggattatatgaatgatgtatcaaaatctgaccagattgttattaatatagattctttgaatatgaacgatatatataataaggataaagatcttttaataaatattttaaaagaaaaacagaatatggaggcagaatataaaaaaatgaatgaaatgtataattacgttaatgaaacagaaaaagaaataataaaacataaaaaaaattatgaaataagaattatggaacatataaaaaaagaaacaaatgaaaaaaaaaaaaaatttatggaatctaataacaaatcattaactactttaatggattcattcagatctatgttttataatgaatatataaatgattataatataaatgaaaattttgaaaaacatcaaaatatattgaatgaaatatataatggatttaatgaatcatataatattattaatacaaaaatgactgaaattataaatgataatttagattataatgaaataaaagaaattaaagaagtagcacaaacagaatatgataaacttaataaaaaagttgatgaattaaaaaattatttgaataatattaaagaacaagaaggacatcgattaattgattatataaaagaaaaaatatttaacttatatataaaatgttcagaacaacaaaatataatagatgattcttataattatattacagttaaaaaacagtatattaaaactattgaagatgtgaaatttttattagattcattgaacacaatagaagaaaaaaataaatcagtagcaaatctagaaatttgtactagtaaagaagatataaaaaatttacttaaacatgttataaagttggcaaatttttcaggtattattgtaatgtctgatacaaatacggaaataactccagaaaatcctttagaagataatgatttattaaatttacaattatattttgaaagaaaacatgaaataacatcaacattggaaaatgattctgatttagagttagatcatttaggtagtaattcggatgaatctatagataatttaaaggtttataatgatattatagaattacacacatattcaacacaaattcttaaatatttagataatattcaaaaacttaaaggagattgcaatgatttagtaaaggattgtaaagaattacgtgaattgtctacggcattatatgatttaaaaatacaaattactagtgtaattaatagagaaaatgatatttcaaataatattgatattgtatctaataaattaaatgaaatagatgctatacaatataattttgaaaaatataaagaaatttttgataatgtagaagaatataaaacattagatgatacaaaaaatgcatatattgtaaaaaaggctgaaattttaaaaaatgtagatataaataaaacaaaagaagatttagatatatattttaatgacttagacgaattagaaaaatctcttacattatcatctaatgaaatggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggatgcatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgatgaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagagagagaaagaatagaaaaagaaaaacaagagaaagaaagactggaaagagagaaacaagaacaactacaaaaagaagaagaattaaaaagacaagagcaagaaagacaagaacaacaacaaaaagaagaagcattaaaaagacaagaacaagaacgactacaaaaagaagaagaattaaaaagacaagagcaagaaaggctggaaagagagaaacaagaacaactacaaaaagaagaagaattaaaaagacaagaacaagaacgactacaaaaagaagaagcattaaaaagacaagaacaagaacgactacaaaaagaagaagaattaaaaagacaagagcaagaaagactggaaagaaagaaaatcgagttagcagaaagagaacaacacataaaaagtaaactagaatctgatatggtgaaaataataaaggatgaactaacaaaagaaaaagatgaaataataaaaaacaaagatataaaacttagacatagtttggaacagaaatggttaaaacatttacaaaatatattatcgttaaaaatagatagtctattaaataaaaatgatgaggtcataaaagataatgagacacaattgaaaacaaatatattgaactcattaaaaaatcaattatatcttaatttgaaacgtgaacttaatgaaattataaaggaatacgaagaaaaccagaaaaaaatattgcattcaaatcaacttgttaacgatagtttagagcaaaaaactaatagactcgtcgatattaaacctacaaagcatggtgatatatatactaataaactttctgataatgaaactgaaatgctgataacatctaaagaaaaaaaagatgaaacagaatcaactaaaagatcaggaacagatcatactaatagttcggaaagtactactgatgataataccaatgatagaaatttttctcgatcaaagaatttgagtgttgctatatacacagcaggaagtgtagctttatgtgtgttaatattttctagtataggattattacttataaagactaatagtggagataacaattctaatgaaattaatgaagcttttgaaccgaatgatgatgttctctttaaggagaaggatgaaatcattgaaatcacttttaatgataatgatagtacaatttaaaatgtatgagataacatattatgtatagaaaatatgataacatgtgagaaaata

SEQ ID NO: 30 - DNA, 9746 bp, Plasmodium falciparum
  ref <308>: DATABASE ACCESSION NUMBER: Genbank accession no: AY138499
tatatatatcgtttctttttcgtgttattaaaatttgaaagtatatatatactaaagctgtaatattattaaatttaattcgttaatatatatatatattattaagtatagtatagtattgaaatatataatcatatatattcttataacataaaatgcttggttttttttttttttttttaattatttataaaagcatgagattatagtatagctatttaaattatgaagatcacactattttgtagcatatctttttgtaatattatatttttcttcttaggtaaaataatatatacattcgaaaacaaattgtgctttgatgttgttcatattttaataattttgtatttttagatctttacaaaggctgtacaatgttctacgttgtgttagtctataatatttactactaaagcgtgtatatatatatatatatatatatatatatatatatatatttatatatttatatatttatatttttatattttgtttcacattcagaattaagtcatgagcattttgttggacaatcaagtaatacccatggagcatcttcagttactgattttaattttagtgaggagaaaaatttaaaaagttttgaagggaagaataataataatgataattatgcttcaattaatcgtttatataggaagaaaccatatatgaagagatcgcttataaatttagaaaatgatctttttagattagaacctatatcttatattcaaagatattataagaagaatataaacagatctgatatttttcataataaaaaagaaagaggttccaaagtatattcaaatgtgtcttcattccattcttttattcaagagggtaaagaagaagttgaggttttttctatatggggtagtaatagcgttttagatcatatagatgttcttagggataatggaactgtcgttttttctgttcaaccatattaccttgatatatatacgtgtaaagaagccatattatttactacatcattttacaaggatcttgataaaagttcaattacaaaaattaatgaagatattgaaaaatttaacgaagaaataatcaagaatgaagaacaatgtttagttggtgggaaaacagattttgataatttacttatagttttagaaaatgcggaaaaagcaaatgttagaaaaacattatttgataatacatttaatgattataaaaataagaaatctagtttttacaattgtttgaaaaataaaaaaaatgattatgataagaaaataaataatataaagaatgagattacaaaattgttaaaaaatattgaaggtacaggaaaaatgtgtaaaacggaatcatatgttatgaataataatttatatctattaagagtgaatgaagttaaaagtacacctattgatttatacttaaatcgagcaaaagagctattagaatcaagtagcaaattagttaatcctataaaaatgaaattaggtgataataagaacatgtactctattggatatatacatgacgaaattaaagatattataaaaagatataattttcatttgaaacatatagaaaaaggaaaagaatatataaaaaggataacacaagcaaataatattgcagacaaaatgaagaaagatgaacttataaaaaaaatttttgaatcctcaaaacattttgctagttttaaatatagcaatgaaatgataagcaaattagattcgttatttataaaaaatgaacaaatacttaataatttattcaataatatatttaatatattcaagaaaaaatatgaaacatatgtagatatgaaaacaattgaatctaaatatacaacagtaatgactctatcagaacatttattagaatatgcaatggatgttttaaaagctaaccctcaaaaacctattgatccaaaagcaaatctggattcagaagtagtaaaattacaaataaaaataaatgagaaatcaaatgaattagataatgctataagtcaagtaaacacactaataataataatgaaatcattttatgatattattatatctgaaaaagcctctatggatgaaatggaaaaaaaggaattatccttaaataattatattgaaaaaacagattatatattacaaacgtatggtatttttaagtctaaaagtaatattataaataataatagtaaaaatattagttctaaatatataattatagaagggttaaaaaatgatattgatgaattaaatagtcttatatcatattttaaggattcacaagaaacattaataaaagatgatgaattaaaaaaaaacatgaaaacggattatcttaataacgtgaaatatatagaagaaaatgttactcatataaatgaaattatattattaaaagattctataactcaacgaatagcagatattgatgaattaaatagtttaaatttaataaatataaatgattttataaatgaaaagaatatatcacaagagaaagtatcatataatcttaataaattatataaaggaagttttgaagaattagaatctgaactatctcattttttagacacaaaatatttgtttcatgaaaaaaaaagtgtaaatgaacttcaaacaattttaaatacatcaaataatgaatgtgctaaattaaattttatgaaatctgataataataataataataataataatagtaatataattaacttgttaaaaactgaattaagtcatctattaagtcttaaagaaaatataataaaaaaacttttaaatcatatagaacaaaatattcaaaactcatcaaataagtatactattacatatactgatattaataatagaatggaagattataaagaagaaatcgaaagtttagaagtatataaacataccattggaaatatacaaaaagaatatatattacatttatatgagaatgataaaaatgctttagctgtacataatacatcaatgcaaatattacaatataaagatgctatacaaaatataaaaaataaaatttctgatgatataaaaattttaaagaaatataaagaaatgaatcaagatttattaaattattatgaaattctagataaaaaattaaaagataatacatatatcaaagaaatgcatactgcttctttagttcaaataactcaatatattccttatgaagataaaacaataagtgaacttgagcaagaatttaataataataatcaaaaacttgataatatattacaagatatcaatgcaatgaatttaaatataaatattctccaaaccttaaatattggtataaatgcatgtaatacaaataataaaaatgtagaacacttacttaacaagaaaattgaattaaaaaatatattaaatgatcaaatgaaaattataaaaaatgatgatataattcaagataatgaaaaagaaaacttttcaaatgttttaaaaaaagaagaggaaaaattagaaaaagaattagatgatatcaaatttaataatttgaaaatggacattcataaattgttgaattcgtatgaccatacaaagcaaaatatagaaagcaatcttaaaataaatttagattctttcgaaaaggaaaaagatagttgggttcattttaaaagtactatagatagtttatatgtggaatataacatatgtaatcaaaagactcataatactatcaaacaacaaaaaaatgatatcatagaacttatttataaacgtataaaagatataaatcaagaaataatcgaaaaggtagataattattattccctgtcagataaagccttaactaaacttaaatctattcattttaatattgataaggaaaaatataaaaatcccaaaagtcaagaaaatattaaattattagaagatagagttatgatacttgagaaaaagattaaggaagataaagatgctttaatacaaattaagaatttatcacatgatcattttgtaaatgctgataatgagaaaaaaaagcagaaggagaaggaggaggacgacgaacaaacacactatagtaaaaaaagaaaagtaatgggagatatatataaggatattaaaaaaaacctagatgagttaaataataaaaatttgatagatattactttaaatgaagcaaataaaatagaatcagaatatgaaaaaatattaattgatgatatttgtgaacaaattacaaatgaagcaaaaaaaagtgatactattaaggaaaaaatcgaatcatataaaaaagatattgattatgtagatgtggacgtttccaaaacgaggaacgatcatcatttgaatggagataaaatacatgattcttttttttatgaagatacattaaattataaagcatattttgataaattaaaagatttatatgaaaatataaacaagttaacaaatgaatcaaatggattaaaaagtgatgctcataataacaacacacaagttgataaactaaaagaaattaatttacaagtattcagcaatttaggaaatataattaaatatgttgaaaaacttgagaatacattacatgaacttaaagatatgtacgaatttctagaaacgatcgatattaataaaatattaaaaagtattcataatagcatgaagaaatcagaagaatatagtaatgaaacgaaaaaaatatttgaacaatcagtaaatataactaatcaatttatagaagatgttgaaatattgaaaacgtctattaacccaaactatgaaagcttaaatgatgatcaaattgatgataatataaaatcacttgttctaaagaaagaggaaatatccgaaaaaagaaaacaagtgaataaatacataacagatattgaatctaataaagaacaatcagatttacatttacgatatgcatctagaagtatatatgttattgatctttttataaaacatgaaataataaatcctagcgatggaaaaaattttgatattataaaggttaaagaaatgataaataaaaccaaacaagtttcaaatgaagctatggaatatgctaataaaatggatgaaaaaaataaggacattataaaaatagaaaatgaactttataatttaattaataataacatccgttcattaaaaggggtaaaatatgaaaaagttaggaaacaagcaagaaatgcaattgatgatataaataatatacattctaatattaaaacgattttaaccaaatctaaagaacgattagatgagattaagaaacaacctaacattaaaagagaaggtgatgttttaaataatgataaaaacaaaatagcttatattacaatacaaataaataacggaagaatagaatctaatttattaaatatattaaatatgaaacataacatagatactatcttgaataaagctatggattatatgaatgatgtatcaaaatctgaccagattgttattaatatagattctttgaatatgaacgatatatataataaggataaagatcttttaataaatattttaaaagaaaaacagaatatggaggcagaatataaaaaaatgaatgaaatgtataattacgttaatgaaacagaaaaagaaataataaaacataaaaaaaattatgaaataagaattatggaacatataaaaaaagaaacaaatgaaaaaaaaaaaaaatttatggaatctaataacaaatcattaactactttaatggattcattcagatctatgttttataatgaatatataaatgattataatataaatgaaaattttgaaaaacatcaaaatatattgaatgaaatatataatggatttaatgaatcatataatattattaatacaaaaatgactgaaattataaatgataatttagattataatgaaataaaagaaattaaagaagtagcacaaacagaatatgataaacttaataaaaaagttgatgaattaaaaaattatttgaataatattaaagaacaagaaggacatcgattaattgattatataaaagaaaaaatatttaacttatatataaaatgttcagaacaacaaaatataatagatgattcttataattatattacagttaaaaaacagtatattaaaactattgaagatgtgaaatttttattagattcattgaacacaatagaagaaaaaaataaatcagtagcaaatctagaaatttgtactagtaaagaagatataaaaaatttacttaaacatgttataaagttggcaaatttttcaggtattattgtaatgtctgatacaaatacggaaataactccagaaaatcctttagaagataatgatttattaaatttacaattatattttgaaagaaaacatgaaataacatcaacattggaaaatgattctgatttagagttagatcatttaggtagtaattcggatgaatctatagataatttaaaggtttataatgatattatagaattacacacatattcaacacaaattcttaaatatttagataatattcaaaaacttaaaggagattgcaatgatttagtaaaggattgtaaagaattacgtgaattgtctacggcattatatgatttaaaaatacaaattactagtgtaattaatagagaaaatgatatttcaaataatattgatattgtatctaataaattaaatgaaatagatgctatacaatataattttgaaaaatataaagaaatttttgataatgtagaagaatataaaacattagatgatacaaaaaatgcatatattgtaaaaaaggctgaaattttaaaaaatgtagatataaataaaacaaaagaagatttagatatatattttaatgacttagacgaattagaaaaatctcttacattatcatctaatgaaatggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggatgtatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgatgaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagagagagaaagaatagaaaaagaaaaacaagagaaagaaagactggaaagagagaaacaagaacaactaaaaaaagaagcattaaaaaaacaagagcaagaaagacaagaacaacaacaaaaagaagaagcattaaaaagacaagaacaagaacgactacaaaaagaagaagaattaaaaagacaagagcaagaaaggctggaaagagagaaacaagaacaactacaaaaagaagaagaattaaaaagacaagaacaagaacgactacaaaaagaagaagcattaaaaagacaagaacaagaacgactacaaaaagaagaagaattaaaaagacaagagcaagaaagactggaaagaaagaaaatcgagttagcagaaagagaacaacacataaaaagtaaactagaatctgatatggtgaaaataataaaggatgaactaacaaaagaaaaagatgaaataataaaaaacaaagatataaaacttagacatagtttggaacagaaatggttaaaacatttacaaaatatattatcgttaaaaatagatagtctattaaataaaaatgatgaggtcataaaagataatgagacacaattgaaaacaaatatattgaactcattaaaaaatcaattatatcttaatttgaaacgtgaacttaatgaaattataaaggaatacgaagaaaaccagaaaaaaatattgcattcaaatcaacttgttaacgatagtttagagcaaaaaactaatagactcgtcgatattaaacctacaaagcatggtgatatatatactaataaactttctgataatgaaactgaaatgctgataacatctaaagaaaaaaaagatgaaacagaatcaactaaaagatcaggaacagatcatactaatagttcggaaagtactactgatgataataccaatgatagaaatttttctcgatcaaagaatttgagtgttgctatatacacagcaggaagtgtagctttatgtgtgttaatattttctagtataggattattacttataaagactaatagtggagataacaattctaatgaaattaatgaagcttttgaaccgaatgatgatgttctctttaaggagaaggatgaaatcattgaaatcacttttaatgataatgatagtacaatttaaaatgtatgagataacatattatgtatagaaaatatgataacatgtgagaaaata

SEQ ID NO: 31 - DNA, 9022 bp, Plasmodium falciparum
  ref <308>: DATABASE ACCESSION NUMBER: Genbank accession no: AF533700
ttaaaatatgcaaaggtggattttctgcaacattgttttgcatatattaatttacttagcaggtaaaataatataaacatatataaacatatataaacatatacatatatatatatgtatattttattttattttattttttttttttttttttccccagaatttagccatgaacaggaaagttattcttccaatgaaaaaataagaaaggactattcagatgataataattatgaacctaccccttcatatgaaaaaagaaaaaaagaatatggaaaagatgaaagttatataaaaaattacagaggtaataatttttcctatgatttgtctaaaaattctagtatatttcttcacatgggtaacggtagtaactcgaaaacactaaaaagatgtaacaagaaaaaaaatataaagaccaattttttaagacctatcgaggaagagaaaacggtattaaataattatgtatataaaggtgtaaattttttagatacaataaaaagaaatgattcctcttataaatttgatgtttataaagatacttcctttttaaaaaatagagaatataaagaattaattactatgcagtatgattatgcttatttagaagcaacaaaagaggttctttatttaattccgaaggataaagattatcacaaattttataaaaatgaacttgagaaaattcttttcaatttaaaagattcacttaaattattaagagaaggatatatacaaagcaaactggaaatgattagaatccattcggatatagatatattaaatgagtttcatcaaggaaatattataaacgataattattttaataatgaaataaaaaaaaaaaaggaagacatggaaaaatatataagagaatataatttatacatatataaatatgaaaatcagcttaaaataaaaatacagaaattaacaaatgaagtttctataaatttaaataaatctacatgtgaaaagaattgttataattatattttaaaattagaaaaatataaaaatataataaaagataagataaataaatggaaagatttaccagaaatatatattgatgataaaagtttctcatatacatttttaaaagatgtaataaataataagatagatatatataaaacaataagttcttttatatctactcagaaacaattatattattttgaatatatatatataatgaataaaaatacattaaacctactttcatataatatacaaaaaacagatataaattctagtagtaaatacacatatacaaaatctcattttttaaaagataatcatatattgttatctaaatattatactgccaaatttattgatatcctaaataaaacatattattataatttatataaaaataaaattcttttattcaataaatatattataaagcttagaaacgatttaaaagaatatgcatttaaatctatacaatttattcaagataaaatcaaaaaacataaagatgaattatccatagaaaatatattacaagaagttaataatatatatataaaatatgatacttcgataaatgaaatatctaaatataacaatttaattattaatactgatttacaaatagtacaacaaaaacttttagaaatcaaacaaaaaaaaaatgatattacacacaaagtacaacttataaatcatatatataaaaatatacatgatgaaatattaaacaaaaaaaataatgaaataacaaagattattataaataatataaaagatcataaaaaagatttacaagatctcttactatttatacaacaaatcaaacaatataatatattaacagatcataaaattacacaatgtaataattattataaggaaatcataaaaatgaaagaagatataaatcatattcatatatatatacaaccaattctaaataatttacacacattaaaacaagtacaaaataataaaatcaaatatgaagagcacatcaaacaaatattacaaaaaatttatgataaaaaggaatctttaaaaaaaattattctcttaaaagatgaagcacaattagacattaccctcctcgatgacttaatacaaaagcaaacaaaaaaacaaacacaaacacaaacacaaacacaaaaacaaacactaatacaaaataatgagacgattcaacttatttctggacaagaagataaacatgaatccaatccatttaatcatatacaaacctatattcaacaaaaagatacacaaaataaaaacatccaaaatcttcttaaatccttgtataatggaaatattaacacattcatagacacaatttctaaatatatattaaaacaaaaagatatagaattaacacaacacgtttatacagacgaaaaaattaatgattatcttgaagaaataaaaaatgaacaaaacaaaatagataagaccatcgacgatataaaaatacaagaaacattaaaacaaataactcatattgttaacaatataaaaaccatcaaaaaggatttgctcaaagaatttattcaacatttaataaaatatatgaacgaaagatatcagaatatgcaacagggttataataatttaacaaattatattaatcaatatgaagaagaaaataataatatgaaacaatatattactaccatacgaaatatccaaaaaatatattatgataatatatatgctaaggaaaaggaaattcgctcgggacaatattataaggattttatcacatcaaggaaaaatatttataatataagggaaaatatatccaaaaatgtagatatgataaaaaatgaagaaaagaagaaaatacagaattgtgtagataaatataattctataaaacaatatgtaaaaatgcttaaaaatggagacacacaagatgaaaataataataataataatgatatatacgacaagttaattgtcccccttgattcaataaaacaaaatatcgataaatacaacacagaacataattttataacatttacaaataaaataaatacacataataagaagaaccaagaaatgatggaagaattcatatatgcatataaaaggttaaaaattttaaaaatattaaatatatccttaaaagcttgtgaaaaaaataataaatctatcaatacattaaatgacaaaacacaagaattaaaaaaaattgtaacacacgaaatagatcttctacaaaaagatattttaacaagtcaaatatcaaataaaaatgttttattattaaacgatttattaaaagaaattgaacaatatattatagatgtacacaaattaaaaaaaaaatcaaacgatctatttacatattatgaacaatccaaaaattatttctattttaaaaacaaaaaagataattttgatatacaaaaaacaatcaataaaatgaatgaatggctagctatcaaaaattatataaatgaaattaataaaaattatcaaacattatatgaaaaaaaaataaatgtactcctacataattcaaaaagttatgtacaatacttttatgatcatataataaatctaattcttcaaaaaaaaaattatttggaaaatactttaaagacaaaaatacaagataacgaacattcactatatgctttacaacaaaatgaagaataccaaaaggtaaagaacgaaaaggatcaaaacgaaattaagaaaattaaacaattaatcgaaaaaaataaaaatgatatacttacatatgaaaacaacattgaacaaattgaacaaaaaaatattgagttaaaaacaaatgctcaaaataaggatgatcaaatagtaaataccttaaatgaggttaagaaaaaaataatatatacatatgaaaaggtagataatcaaatatcgaacgttttaaaaaattatgaagaaggaaaagtagaatatgataaaaatgttgtacaaaatgttaacgatgcggatgatacaaacgatattgatgaaataaacgatattgatgaaataaacgatattgatgaaataaacgatattgatgaaataaacgatattgatgaaataaaagacattgaccatataaaacattttgacgatacaaaacattttgacgatatataccatgctgatgatacacgtgatgaataccatatagccctttcaaattatataaagacagaactaagaaatataaacctgcaagaaataaaaaacaatataataaaaatatttaaagaattcaaatctgcacacaaagaaattaaaaaagaatcagaacaaattaataaagaatttaccaaaatggatgtcgtcataaatcaattaagagatatagacagacaaatgcttgatctttataaagaattagatgaaaaatattctgaatttaataaaacaaaaattgaagaaataaataatataagggaaaatattaataatgtggaaatatggtatgaaaaaaatataattgaatatttcttacgtcatatgaatgatcaaaaagataaagctgcaaaatatatggaaaacattgatacatataaaaataatattgaaattattagtaaacaaataaatccagaaaattatgttgaaacattaaacaaatcaaatatgtattcttatgtagaaaaggctaatgatctattttataaacaaataaataatataatcataaattcaaatcaactaaaaaacgaagcttttacaatagatgaattacaaaatattcaaaaaaacagaaaaaatcttcttacaaagaaacaacaaattattcagtatacaaatgaaatagaaaatatatttaatgaaattaaaaatattaataacatattagtcttaacaaattataaatctatccttcaagatatatcacaaaatataaatcatgttagtatatatacggaacaattacataatttatatataaaattagaagaagaaaaagaacaaatgaaaacactctatcataaatcaaatgtgttacataaccaaattaattttaatgaagatgcttttattaataatttattaattaatatagaaaaaattaaaaatgatattacacatataaaggaaaaaacaaatatatatatgatagatgtaaacaaatctaaaaataatgctcaactatattttcataatacactaagaggtaatgaaaaaatagaatatttaaaaaatcttaagaattcaacaaaccaacaaataactttacaagaattaaaacaagtacaagaaaatgttgagaaggtaaaagatatatacaatcaaactataaaatatgaagaaaaaattaaaaaaaattatcatattataacagattatgagaataaaataaatgatattttacataattcatttattaaacaaataaatatggaatctagcaataataaaaaacaaacaaaacaaattatagacataataaacgataaaacatttgaagaacatataaaaacatccaaaaccaaaataaacatgctaaaagaacaatcacaaatgaaacatatagacaaaactttattaaatgaacaagcactcaaattatttgtagatattaattctactaataataatttagataatatgttatctgaaataaattctatacaaaataatatacatacatatatccaagaagcaaacaaatcatttgacaaatttaaaattatatgtgatcaaaatgtaaacgatttattaaacaaattaagtttaggagatctaaattatatgaatcatttaaaaaatctgcaaaacgaaataagaaacatgaatctagaaaaaaatttcatgttagataaaagtaaaaaaatagatgaggaagaaaaaaaattagatatattaaaagttaacatatcaaatataaataattctttagataaattaaaaaaatattacgaagaagcgctctttcaaaaggttaaagaaaaagcagaaattcaaaaggaaaatatagaaaaaataaaacaagaaataaatacactgagcgatgtttttaagaaaccatttttttttatacaacttaatacagattcatcacaacatgaaaaagatataaacaataatgtagaaacatataaaaataatatagatgaaatatataatgtttttatacaatcatataatttaatacaaaaatattcttcagaaattttttcatccaccttgaattatatacaaacaaaagaaataaaagaaaaatccataaaggaacaaaaccaattaaatcaaaatgaaaaggaagcatctgttttattaaaaaatataaaaataaatgaaaccataaaattatttaaacaaataaaaaatgaaagacaaaacgatgtacacaatataaaagaggactataacttgttacaacaatatttaaattatatgaaaaatgaaatggaacaattaaaaaaatataaaaatgatgttcatatggataaaaattatgttgaaaataataatggtgaaaaagaaaaattacttaaagaaaccatttcttcatattatgataaaataaataatataaataataagctatatatatataaaaacaaagaagacacttattttaataatatgatcaaagtatcagaaattttaaacataattataaaaaaaaaacaacaaaatgaacaaagaattgttataaatgcagaatatgactcttcattaattaataaggatgaagaaattaaaaaagaaattaataatcaaataattgaattaaataaacataatgaaaatatttccaatatttttaaggatatacaaaatataaaaaaacaaagtcaagatattatcacaaatatgaacgacatgtataaaagtacaatccttttagtagacatcatacagaaaaaagaagaagctctaaataaacaaaaaaatattttaagaaatatagacaatatattaaataaaaaagaaaatattatagataaagttataaaatgtaattgtgatgattataaagatatcttaatacaaaacgaaacggaatatcaaaaattacaaaatataaatcatacatatgaagaaaaaaaaaaatcaatagatatattaaaaattaaaaatataaaacaaaaaaatattcaagaatataaaaacaaattagaacaaatgaatacaataattaatcaaagtatagaacaacatgtattcataaacgctgatattttacaaaatgaaaaaataaaattagaagaaatcataaaaaatctagatatactagatgaacaaattatgacatatcataattcaatagatgaattatataaactaggaatacaatgtgacaatcatctaattacaactattagtgttgttgttaataaaaatacaacaaaaattatgatacatataaaaaaacaaaaagaggatatacaaaaaattaataactatattcaaacaaattataatataataaatgaagaagctctacaatttcacaggctctatggacacaatcttataagtgaagatgacaaaaataatttggtacatattataaaagaacaaaagaatatatatacacaaaaggaaatagatatttctaaaataattaaacatgttaaaaaaggattatattcattgaatgaacatgatatgaatcatgatacacatatgaatataataaatgaacatataaataataatattttacaaccatacacacaattaataaacatgataaaagatattgataatgtttttataaaaatacaaaataataaattcgaacaaatacaaaaatatatagaaattattaaatctttagaacaattaaataaaaatataaacacagataatttaaataaattaaaagatacacaaaacaaattaataaatatagaaacagaaatgaaacataaacaaaaacaattaataaacaaaatgaatgatatagaaaaggataatattacagatcaatatatgcatgatgttcagcaaaatatatttgaacctataacattaaaaatgaatgaatataatacattattaaatgataatcataataataatataaataatgaacatcaatttaatcatttaaatagtcttcatacaaaaatatttagtcataattataataaagaacaacaacaagaatatataaccaacatcatgcaaagaattgatgtattcataaatgatttagatacttaccaatatgaatattatttttatgaatggaatcaagaatataaacaaatagacaaaaataaaataaatcaacatataaacaatattaaaaataatctaattcatgttaagaaacaatttgaacacaccttagaaaatataaaaaataatgaaaatattttcgacaacatacaattgaaaaaaaaagatattgacgatattattataaacattaataatacaaaagaaacatatctaaaagaattgaacaaaaaaaaaaatgttacaaaataaaaaaaaagttgatgaaaaatcagaaataaataatcatcacacattacaacatgataatcaaaatgttgaacaaaaaaataaaattaaagatcataatttaataaccaagccaaataacaattcatcagaagaatctcatcaaaatgaacaaatgaaagaacaaaacaaaaatatacttgaaaaacaaacaagaaatatcaaaccacatcatgttcataatcataatcataatcataatcaaaatcaaaaagattcaacaaaattacaggaacaagatatatctacacacaaattacataatactatacatgagcaacaaagtaaagataatcatcaaggtaatagagaaaaaaaacaaaaaaatggaaaccatgaaagaatgtattttgccagtggaatagttgtatccattttatttttatctagtcttggatttgttataaatagtaaaaataataaacaagaatatgataaagagcaagaaaaacaacaacaaaatgattttgtatgtgataataacaaaatggatgataaaagcacacaaaaatatggtagaaatcaagaagaggtaatggagatatcttttgataatgattatatttaa

SEQ ID NO: 32 - DNA, 9044 bp, Plasmodium falciparum
  ref <308>: DATABASE ACCESSION NUMBER: Genbank accession no: AF411933
ttaaaatatgcaaaggtggattttctgcaacattgttttgcatatattaatttacttagcaggtaaaataatataaacatatataaacatatacatatatatatatgtatattttattttattttattttttttttttttttttccccagaatttagccatgaacaggaaagttattcttccaatgaaaaaataagaaaggactattcagatgataataattatgaacctaccccttcatatgaaaaaagaaaaaaagaatatggaaaagatgaaagttatataaaaaattacagaggtaataatttttcctatgatttgtctaaaaattctagtatatttcttcacatgggtaacggtagtaactcgaaaacactaaaaagatgtaacaagaaaaaaaatataaagaccaattttttaagacctatcgaggaagagaaaacggtattaaataattatgtatataaaggtgtaaattttttagatacaataaaaagaaatgattcctcttataaatttgatgtttataaagatacttcctttttaaaaaatagagaatataaagaattaattactatgcagtatgattatgcttatttagaagcaacaaaagaggttctttatttaattccgaaggataaagattatcacaaattttataaaaatgaacttgaggaaattcttttcaatttaaaagattcacttaaattattaagagaaggatatatacaaagcaaactggaaatgattagaatccattcggatatagatatattaaatgagtttcatcaaggaaatattataaacgataattattttaataatgaaataaaaaaaaaaaaggaagacgtggaaaaatatataagagaatataatttatacatatataaatatgaaaatcagcttaaaataaaaatacagaaattaacaaatgaagtttctataaatttaaataaatctacatgtgaaaagaattgttataattatattttaaaattagaaaaatataaaaatataataaaagataagataaataaatggaaagatttaccagaaatatatattgatgataaaagtttctcatatacatttttaaaagatgtaataaataataagatagatatatataaaacaataagttcttttatatctactcagaaacaattatattatcttgaatatatatatataatgaataaaaatacattaaacctactttcatataatatacaaaaaacagatataaattctagtagtaaatacacatatacaaaatctcattttttaaaagataatcatatattgttatctaaatattatactgccaaatttattgatatcctaaataaaacatattattataatttatataaaaataaaattcttttattcaataaatatattataaatcttagaaacgatttaaaagaatatgcatttaaatctatacaatttattcaagataaaatcaaaaaacataaagatgaattatccatagaaaatatattacaagaagttaataatatatatataaaatatgatacttcgataaatgaaatatctaaatataacaatttaattattaatactgatttacaaatagtacaacaaaaacttttagaaatcaaacaaaaaaaaaatgatattacacacaaagtacaacttataaatcatatatataaaaatatacatgatgaaatattaaacaaaaaaaataatgaaataacaaagattattataaataatataaaagatcataaaaaagatttacaagatctcttactatttatacaacaaatcaaacaatataatatattaacagatcataatattacacaatgtaataattattataaggaaatcataaaaatgaaagaagatataaatcatattcatatatatatacaaccaattctaaataatttacacacattaaaacaagtacaaaataataaaatcaaatatgaagagcacatcaaacaaatattacaaaaaatttatgataaaaaggaatctttaaaaaaaattattctcttaaaagatgaagcacaattagacattaccctcctcgatgacttaatacaaaagcaaacaaaaaaacaaacacaaacacaaacacaaacacaaaaacaaacactaatacaaaataatgagacgattcaacttatttctggacaagaagataaacatgaatccaatccatttaatcatatacaaacctatattcaacaaaaagatacacaaaataaaaacatccaaaatcttcttaaatccttgtataatggaaatattaacacattcatagacacaatttctaaatatatattaaaacaaaaagatatagaattaacacaacacgtttatacagacgaaaaaattaatgattatcttgaagaaataaaaaatgaacaaaacaaaatagataagaccatcgacgatataaaaatacaagaaacattaaaacaaataactcatattgttaacaatataaaaaccatcaaaaaggatttgctcaaagaatttattcaacatttaataaaatatatgaacgaaagatatcagaatatgcaacagggttataataatttaacaaattatattaatcaatatgaagaagaaaataataatatgaaacaatatattactaccatacgaaatatccaaaaaatatattatgataatatatatgctaaggaaaaggaaattcgctcgggacaatattataaggattttatcacatcaaggaaaaatatttataatataagggaaaatatatccaaaaatgtagatatgataaaaaatgaagaaaagaagaaaatacagaattgtgtagataaatataattctataaaacaatgtgtaaaaatgcttaaaaatggagacacacaagatgaaaataataataataataataataataataataatgatatatacgacaagttaattgtcccccttgattcaataaaacaaaatatcgataaatacaacacagaacataattttataacatttacaaataaaataaatacacataataagaagaaccaagaaatgatggaagaattcatatatgcatataaaaggttaaaaattttaaaaatattaaatatatccttaaaagcttgtgaaaaaaataataaatctatcaatacattaaatgacaaaacacaagaattaaaaaaaattgtaacacacgaaatagatcttctacaaaaagatattttaacaagtcaaatatcaaataaaaatgttttattattaaacgatttattaaaagaaattgaacaatatattatagatgtacacaaattaaaaaaaaaatcaaacgatctatttacatattatgaacaatccaaaaattatttctattttaaaaacaaaaaagataattttgatatacaaaaaacaatcaataaaatgaatgaatggctagctatcaaaaattatataaatgaaattaataaaaattatcaaacattatatgaaaaaaaaataaatgtactcctacataattcaaaaagttatgtacaatacttttatgatcatataataaatctaattcttcaaaaaaaaaattatttggaaaatactttaaagacaaaaatacaagataacgaacattcactatatgctttacaacaaaatgaagaataccaaaaggtaaagaacgaaaaggatcaaaacgaaattaagaaaattaaacaattaatcgaaaaaaataaaaatgatatacttacatatgaaaacaacattgaacaaattgaacaaaaaaatattgagttaaaaacaaatgctcaaaataaggatgatcaaatagtaaataccttaaatgaggttaagaaaaaaataatatatacatatgaaaaggtagataatcaaatatcgaacgttttaaaaaattatgaagaaggaaaagtagaatatgataaaaatgttgtacaaaatgttaacgatgcggatgatacaaacgatattgatgaaataaacgatattgatgaaataaacgatattgatgaaataaacgatattgatgaaataaaagacattgaccatataaaacattttgacgatacaaaacattttgacgatatataccatgctgatgatacacgtgatgaataccatatagccctttcaaattatataaagacagaactaagaaatataaacctgcaagaaataaaaaacaatataataaaaatatttaaagaattcaaatctgcacacaaagaaattaaaaaagaatcaaaacaaattaataaagaatttaccaaaatggatgtcgtcataaatcaattaagagatatagacagacaaatgcttgatctttataaagaattagatgaaaaatattctgaatttaataaaacaaaaattgaagaaataaataatataagggaaaatattaataatgtggaaatatggtatgaaaaaaatataattgaatatttcttacgtcatatgaatgatcaaaaagataaagctgcaaaatatatggaaaacattgatacatataaaaataatattgaaattattagtaaacaaataaatccagaaaattatgttgaaacattaaacaaatcaaatatgtattcttatgtagaaaaggctaatgatctattttataaacaaataaataatataatcataaattcaaatcaactaaaaaacgaagcttttacaatagatgaattacaaaatattcaaaaaaacagaaaaaatcttcttacaaagaaacaacaaattattcagtatacaaatgaaatagaaaatatatttaatgaaattaaaaatattaataacatattagtcttaacaaattataaatctatccttcaagatatatcacaaaatataaatcatgttagtatatatacggaacaattacataatttatatataaaattagaagaagaaaaagaacaaatgaaaacactctatcataaatcaaatgtgttacataaccaaattaattttaatgaagatgcttttattaataatttattaattaatatagaaaaaattaaaaatgatattacacatataaaggaaaaaacaaatatatatatgatagatgtaaacaaatctaaaaataatgctcaactatattttcataatacactaagaggtaatgaaaaaatagaatatttaaaaaatcttaagaattcaacaaaccaacaaataactttacaagaattaaaacaagtacaagaaaatgttgagaaggtaaaagatatatacaatcaaactataaaatatgaagaaaaaattaaaaaaaattatcatattataacagattatgagaataaaataaatgatattttacataattcatttattaaacaaataaatatggaatctagcaataataaaaaacaaacaaaacaaattatagacataataaacgataaaacatttgaagaacatataaaaacatccaaaaccaaaataaacatgctaaaagaacaatcacaaatgaaacatatagacaaaactttattaaatgaacaagcactcaaattatttgtagatattaattctactaataataatttagataatatgttatctgaaataaattctatacaaaataatatacatacatatatccaagaagcaaacaaatcatttgacaaatttaaaattatatgtgatcaaaatgtaaacgatttattaaacaaattaagtttaggagatctaaattatatgaatcatttaaaaaatctgcaaaacgaaataagaaacatgaatctagaaaaaaatttcatgttagataaaagtaaaaaaatagatgaggaagaaaaaaaattagatatattaaaagttaacatatcaaatataaataattctttagataaattaaaaaaatattacgaagaagcgctctttcaaaaggttaaagaaaaagcagaaaatcaaaaggaaaatatagaaaaaataaaacaagaaataaatacactgagcgatgtttttaagaaaccatttttttttatacaacttaatacagattcatcacaacatgaaaaagatataaataataatgtagaaacatataaaaataatatagatgaaatatataatgtttttatacaatcatataatttaatacaaaaatattcttcagaaattttttcatccaccttgaattatatacaaacaaaagaaataaaagaaaaatccataaaggaacaaaaccaattaaatcaaaatgaaaaggaagcatctgttttattaaaaaatataaaaataaatgaaaccataaaattatttaaacaaataaaaaatgaaagacaaaacgatgtacacaatataaaagaggactataacttgttacaacaatatttaaattatatgaaaaatgaaatggaacaattaaaaaaatataaaaatgatgttcatatggataaaaattatgttgaaaataataatggtgaaaaagaaaaattacttaaagaaaccatttcttcatattatgataaaataaataatataaataataagctatatatatataaaaacaaagaagacacttattttaataatatgatcaaagtttcagaaattttaaacataattataaaaaaaaaacaacaaaatgaacaaagaattgttataaatgcagaatatgactcttcattaattaataaggatgaagaaattaaaaaagaaattaataatcaaataattgaattaaataaacataatgaaaatatttccaatatttttaaggatatacaaaatataaaaaaacaaagtcaagatattatcacaaatatgaatgacatgcataaaagtacaatccttttagtagacatcatacagaaaaaagaagaagctctaaataaacaaaaaaatattttaagaaatatagacaatatattaaataaaaaagaaaatattatagataaagttataaaatgtaattgtgatgattataaagatatcttaatacaaaacgaaacggaatatcaaaaattacaaaatataaatcatacatatgaagaaaaaaaaaaatcaatagatatattaaaaattaaaaatataaaacaaaaaaatattcaagaatataaaaacaaattagaacaaatgaatacaataattaatcaaagtatagaacaacatgtattcataaacgctgatattttacaaaatgaaaaaataaaattagaagaaatcataaaaaatctagatatactagatgaacaaattatgacatatcataattcaatagatgaattatataaactaggaatacaatgtgacaatcatctaattacaactattagtgttgttgttaataaaaatacaacaaaaattatgatacatataaaaaaacaaaaagaggatatacaaaaaattaataactatattcaaacaaattataatataataaatgaagaagctctacaatttcacaggctctatggacacaatcttataagtgaagatgacaaaaataatttggtacatattataaaagaacaaaagaatatatatacacaaaaggaaatagatatttctaaaataattaaacatgttaaaaaaggattatattcattgaatgaacatgatatgaatcatgatacacatatgaatataataaatgaacatataaataataatattttacaaccatacacacaattaataaacatgataaaagatattgataatgtttttataaaaatacaaaataataaattcgaacaaatacaaaaatatatagaaattattaaatctttagaacaattaaataaaaatataaacacagataatttaaataaattaaaagatacacaaaacaaattaataaatatagaaacagaaatgaaacataaacaaaaacaattaataaacaaaatgaatgatatagaaaaggataatattacagatcaatatatgcatgatgttcagcaaaatatatttgaacctataacattaaaaatgaatgaatataatacattattaaatgataatcataataataatataaataatgaacatcaatttaatcatttaaatagtcttcatacaaaaatatttagtcataattataataaagaacaacaacaagaatatataaccaacatcatgcaaagaattgatgtattcataaatgatttagatacttaccaatatgaatattatttttatgaatggaatcaagaatataaacaaatagacaaaaataaaataaatcaacatataaacaatattaaaaataatctaattcatgttaagaaacaatttgaacacaccttagaaaatataaaaaataatgaaaatattttcgacaacatacaattgaaaaaaaaagatattgacgatattattataaacattaataatacaaaagaaacatatctaaaagaattgaacaaaaaaaaaatgttacaaaataaaaaaaaagttgatgaaaaatcagaaataaataatcatcacacattacaacatgataatcaaaatgttgaacaaaaaaataaaattaaagatcataatttaataaccaagccaaataacaattcatcagaagaatctcatcaaaatgaacaaatgaaagaacaaaacaaaaatatacttgaaaaacaaacaagaaatatcaaaccacatcatgttcataatcataatcataatcataatcataatcataatcaaaatcaaaatcaaaaagattcaacaaaattacaggaacaagatatatctacacacaaattacataatactatacatgagcaacaaagtaaagataatcatcaaggtaatagagaaaaaaaacaaaaaaatggaaaccatgaaagaatgtattttgccagtggaatagttgtatccattttatttttatctagtcttggatttgttataaatagtaaaaataataaacaagaatatgataaagagcaagaaaaacaacaacaaaatgattttgtatgtgataataacaaaatggatgataaaagcacacaaaaatatggtagaaatcaagaagaggtaatggagatatcttttgataatgattatatttaatagaagctgttgacgaag

SEQ ID NO: 33 - DNA, 9024 bp, Plasmodium falciparum
  ref <308>: DATABASE ACCESSION NUMBER: Genbank accession no: AF411930
ttaaaatatgcaaaggtggattttctgcaacattgttttgcatatattaatttacttagcaggtaaaataatataaacatatataaacatatataaacatatataaacatatacatatatatatatgtatattttattttattttatttttttttttttttttccccagaatttagccatgaacaggaaagttattcttccaatgaaaaaataagaaaggactattcagatgataataattatgaacctaccccttcatatgaaaaaagaaaaaaagaatatggaaaagatgaaagttatataaaaaattacagaggtaataatttttcctatgatttgtctaaaaattctagtatatttcttcacatgggtaacggtagtaactcgaaaacactaaaaagatgtaacaagaaaaaaaatataaagaccaattttttaagacctatcgaggaagagaaaacggtattaaataattatgtatataaaggtgtaaattttttagatacaataaaaagaaatgattcctcttataaatttgatgtttataaagatacttcctttttaaaaaatagagaatataaagaattaattactatgcagtatgattatgcttatttagaagcaacaaaagaggttctttatttaattccgaaggataaagattatcacaaattttataaaaataaacttgagaaaattcttttcaatttaaaagattcacttaaattattaagagaaggatatatacaaagcaaactggaaatgattagaatccattcggatatagatatattaaatgagtttcatcaaggaaatattataaacgataattattttaataatgaaataaaaaaaaaaaaggaagacatggaaaaatatataagagaatataatttatacatatataaatatgaaaatcagcttaaaataaaaatacagaaattaacaaatgaagtttctataaatttaaataaatctacatgtgaaaagaattgttataattatattttaaaattagaaaaatataaaaatataataaaagataagataaataaatggaaagatttaccagaaatatatattgatgataaaagtttctcatatacatttttaaaagatgtaataaataataagatagatatatataaaacaataagttcttttatatctactcagaaacaattatattatcttgaatatatatatataatgaataaaaatacattaaacctactttcatataatatacaaaaaacagatataaattctagtagtaaatacacatatacaaaatctcattttttaaaagataatcatatattgttatctaaatattatactgccaaatttattgatatcctaaataaaacatattattataatttatataaaaataaaattcttttattcaataaatatattataaagcttagaaacgatttaaaagaatatgcatttaaatctatacaatttattcaagataaaatcaaaaaacataaagatgaattatccatagaaaatatattacaagaagttaataatatatatataaaatatgatacttcgataaatgaaatatctaaatataacaatttaattattaatactgatttacaaatagtacaacaaaaacttttagaaatcaaacaaaaaaaaaatgatattacacacaaagtacaacttataaatcatatatataaaaatatacatgatgaaatattaaacaaaaaaaataatgaaataacaaagattattataaataatataaaagatcataaaaaagatttacaagatctcttactatttatacaacaaatcaaacaatataatatattaacagatcataatattacacaatgtaataattattataaggaaatcataaaaatgaaagaagatataaatcatattcatatatatatacaaccaattctaaataatttacacacattaaaacaagtacaaaataataaaatcaaatatgaagagcacatcaaacaaatattacaaaaaatttatgataaaaaggaatctttaaaaaaaattattctcttaaaagatgaagcacaattagacattaccctcctcgatgacttaatacaaaagcaaacaaaaaaacaaacacaaaaacaaacacaaacacaaaaacaaacactaatacaaaataatgagacgattcaacttatttctggacaagaagataaacatgaatccaatccatttaatcatatacaaacctatattcaacaaaaagatacacaaaataaaaacatccaaaatcttcttaaatccttgtataatggaaatattaacacattcatagacacaatttctaaatatatattaaaacaaaaagatatagaattaacacaacacgtttatacagacgaaaaaattaatgattatcttgaagaaataaaaaatgaacaaaacaaaatagataagaccatcgacgatataaaaatacaagaaacattaaaacaaataactcatattgttaacaatataaaaaccatcaaaaaggatttgctcaaagaatttattcaacatttaataaaatatatgaacgaaagatatcagaatatgcaacagggttataataatttaacaaattatattaatcaatatgaagaagaaaataataatatgaaacaatatattactaccatacgaaatatccaaaaaatatattatgataatatatatgctaaggaaaaggaaattcgctcgggacaatattataaggattttatcacatcaaggaaaaatatttataatataagggaaaatatatccaaaaatgtagatatgataaaaaatgaagaaaagaagaaaatacagaattgtgtagataaatataattctataaaacaatatgtaaaaatgtttaaaaatggagacacacaagatgaaaataataataataataatgatatatacgacaagttaattgtcccccttgattcaataaaacaaaatatcgataaatacaacacagaacataattttataacatttacaaataaaataaatacacataataagaagaaccaagaaatgatggaagaattcatatatgcatataaaaggttaaaaattttaaaaatattaaatatatccttaaaagcttgtgaaaaaaataataaatctatcaatacattaaatgacaaaacacaagaattaaaaaaaattgtaacacacgaaatagatcttctacaaaaagatattttaacaagtcaaatatcaaataaaaatgttttattattaaacgatttattaaaagaaattgaacaatatattatagatgtacacaaattaaaaaaaaaatcaaacgatctatttacatattatgaacaatccaaaaattatttctattttaaaaacaaaaaagataattttgatatacaaaaaacaatcaataaaatgaatgaatggctagctatcaaaaattatataaatgaaattaataaaaattatcaaacattatatgaaaaaaaaataaatgtactcctacataattcaaaaagttatgtacaatacttttatgatcatataataaatctaattcttcaaaaaaaaaattatttggaaaatactttaaagacaaaaatacaagataacgaacattcactatatgctttacaacaaaatgaagaataccaaaaggtaaagaacgaaaaggatcaaaacgaaattaagaaaattaaacaattaatcgaaaaaaataaaaatgatatacttacatatgaaaacaacattgaacaaattgaacaaaaaaatattgagttaaaaacaaatgctcaaaataaggatgatcaaatagtaaataccttaaatgaggttaagaaaaaaataatatatacatatgaaaaggtagataatcaaatatcgaacgttttaaaaaattatgaagaaggaaaagtagaatatgataaaaatgttgtacaaaatgttaacgatgcggatgatacaaacgatattgatgaaataaacgatattgatgaaataaacgatattgatgaaataaaagacattgaccatataaaacattttgacgatacaaaacattttgacgatatataccatgctgatgatacacgtgatgaataccatatagccctttcaaattatataaagacagaactaagaaatataaacctgcaagaaataaaaaacaatataataaaaatatttaaagaattcaaatctgcacacaaagaaattaaaaaagaatcagaacaaattaataaagaatttaccaaaatggatgtcgtcataaatcaattaagagatatagacagacaaatgcttgatctttataaagaattagatgaaaaatattctgaatttaataaaacaaaaattgaagaaataaataatataagggaaaatattaataatgtggaaatatggtatgaaaaaaatataattgaatatttcttacgtcatatgaatgatcaaaaagataaagctgcaaaatatatggaaaacattgatacatataaaaataatattgaaattattagtaaacaaataaatccagaaaattatgttgaaacattaaacaaatcaaatatgtattcttatgtagaaaaggctaatgatctattttataaacaaataaataatataatcataaattcaaatcaactaaaaaacgaagcttttacaatagatgaattacaaaatattcaaaaaaacagaaaaaatcttcttacaaagaaacaacaaattattcagtatacaaatgaaatagaaaatatatttaatgaaattaaaaatattaataacatattagtcttaacaaattataaatctatccttcaagatatatcacaaaatataaatcatgttagtatatatacggaacaattacataatttatatataaaattagaagaagaaaaagaacaaatgaaaacactctatcataaatcaaatgtgttacataaccaaattaattttaatgaagatgcttttattaataatttattaattaatatagaaaaaattaaaaatgatattacacatataaaggaaaaaacaaatatatatatgatagatgtgaacaaatctaaaaataatgctcaactatattttcataatacactaagaggtaatgaaaaaatagaatatttaaaaaatcttaagaattcaacaaaccaacaaataactttacaagaattaaaacaagtacaagaaaatgttgagaaggtaaaagatatatacaatcaaactataaaatatgaagaagaaattaaaaaaaattatcatattataacagattatgagaataaaataaatgatattttacataattcatttattaaacaaataaatatggaatctagcaataataaaaaacaaacaaaacaaattatagacataataaacgataaaacatttgaagaacatataaaaacatccaaaaccaaaataaacatgctaaaagaacaatcacaaatgaaacatatagacaaaactttattaaatgaacaagcactcaaattatttgtagatattaattctactaataataatttagataatatgttatctgaaataaattctatacaaaataatatacatacatatatccaagaagcaaacaaatcatttgacaaatttaaaattatatgtgatcaaaatgtaaacgatttattaaacaaattaagtttaggagatctaaattatatgaatcatttaaaaaatctgcaaaacgaaataagaaacatgaatctagaaaaaaatttcatgttagataaaagtaaaaaaatagatgaggaagaaaaaaaattagatatattaaaagttaacatatcaaatataaataattctttagataaattaaaaaaatattacgaagaagcgctctttcaaaaggttaaagaaaaagcagaaattcaaaaggaaaatatagaaaaaataaaacaagaaataaatacactgagcgatgtttttaagaaaccatttttttttatacaacttaatacagattcatcacaacatgaaaaagatataaacaataatgtagaaacatataaaaataatatagatgaaatatataatgtttttatacaatcatataatttaatacaaaaatattcttcagaaattttttcatccaccttgaattatatacaaacaaaagaaataaaagaaaaatccataaaggaacaaaaccaattaaatcaaaatgaaaaggaagcatctgttttattaaaaaatataaaaataaatgaaaccataaaattatttaaacaaataaaaaatgaaagacaaaacgatgtacacaatataaaagaggactataacttgttacaacaatatttaaattatatgaaaaatgaaatggaacaattaaaaaaatataaaattgatgttcatatggataaaaattatgttgaaaataataatggtgaaaaagaaaaattacttaaagaaaccatttcttcatattatgataaaataaataatataaataataagctatatatatataaaaacaaagaagacacttattttaataatatgatcaaagtttccgaaattttaaacataattataaaaaaaaaacaacaaaatgaacaaagaattgttataaatgcagaatatgactcttcattaattaataaggatgaagaaattaaaaaagaaattaataatcaaataattgaattaaataaacataatgaaaatatttccaatatttttaaggatatacaaaatataaaaaaacaaagtcaagatattatcacaaatatgaacgacatgtgtaaaagtacaatccttttagtagacatcatacagaaaaaagaagaagctctaaataaacaaaaaaatattttaagaaatatagacaatatattaaataaaaaagaaaatattatagataaagttataaaatgtaattgtgatgattataaagatatcttaatacaaaacgaaacggaatatcaaaaattacaaaatataaatcatacatatgaagaaaaaaaaaaatcaatagatatattaaaaattaaaaatataaaacaaaaaaatattcaagaatataaaaacaaattagaacaaatgaatacaataattaatcaaagtatagaacaacatgtattcataaacgctgatattttacaaaatgaaaaaataaaattagaagaaatcataaaaaatctagatatactagatgaacaaattatgacatatcataattcaatagatgaattatataaactaggaatacaatgtgacaatcatctaattacaactattagtgttgttgttaataaaaatacaacaaaaattatgatacatataaaaaaacaaaaagaggatatacaaaaaattaataactatattcaaacaaattataatataataaatgaagaagctctacaatttcacaggctctatggacacaatcttataagtgaagatgacaaaaataatttggtacatattataaaagaacaaaagaatatatatacacaaaaggaaatagatatttctaaaataattaaacatgttaaaaaaggattatattcattgaatgaacatgatatgaatcatgatacacatatgaatataataaatgaacatataaataataatattttacaaccatacacacaattaataaacatgataaaagatattgataatgtttttataaaaatacaaaataataaattcgaacaaatacaaaaatatatagaaattattaaatctttagaacaattaaataaaaatataaacacagataatttaaataaattaaaagatacacaaaacaaattaataaatatagaaacagaaatgaaacataaacaaaaacaattaataaacaaaatgaatgatatagaaaaggataatattacagatcaatatatgcatgatgttcagcaaaatatatttgaacctataacattaaaaatgaatgaatataatacattattaaatgatgatcataataataatataaataatgaacatcaatttaatcatttaaatagtcttcatacaaaaatatttagtcataattataataaagaacaacaacaagaatatataaccaacatcatgcaaagaattgatgtattcataaatgatttagatacttaccaatatgaatattatttttatgaatggaatcaagaatataaacaaatagacaaaaataaaataaatcaacatataaacaatattaaaaataatctaattcatgttaagaaacaatttgaacacaccttagaaaatataaaaaataatgaaaatattttcgacaacatacaattgaaaaaaaaagatattgacgatattattataaacattaataatacaaaagaaacatatctaaaagaattgaacaaaaaaaaaatgttacaaaataaaaaaaaagttgatgaaaaatcagaaataaataatcatcacacattacaacatgataatcaaaatgttgaacaaaaaaataaaattaaagatcataatttaataaccaagccaaataacaattcatcagaagaatctcatcaaaatgaacaaatgaaagaacaaaacaaaaatatacttgaaaaacaaacaagaaatatcaaaccacatcatgttcataatcataatcataatcataatcataatcataatcataatcataatcataatcaaaatcaaaaagattcaacaaaattacaggaacaagatatatctacacacaaattacataatactatacatgagcaacaaagtaaagataatcatcaaggtaatagagaaaaaaaacaaaaaaatggaaaccatgaaagaatgtattttgccagtggaatagttgtatccattttatttttatctagtcttggatttgttataaatagtaaaaataataaacaagaatatgataaagagcaagaaaaacaacaacaaaatgattttgtatgtgataataacaaaatggatgataaaagcacacaaaaatatggtagaaatcaagaagaggtaatggagatatcttttgataatgattatatttaa

SEQ ID NO: 34 - DNA, 8979 bp, Plasmodium falciparum
  ref <308>: DATABASE ACCESSION NUMBER: Genbank accession no: AF411931
ttaaaatatgcaaaggtggattttctgcaacattgttttgcatatattaatttacttagcaggtaaaataatataaacatatataaacatatataaacatatacatatatatatatgtatattttattttattttattttttttttttttttttccccagaatttagccatgaacaggaaagttattcttccaatgaaaaaataagaaaggactattcagatgataataattatgaacctaccccttcatatgaaaaaagaaaaaaagaatatggaaaagatgaaagttatataaaaaattacagaggtaataatttttcctatgatttgtctaaaaattctagtatatttcttcacatgggtaacggtagtaactcgaaaacactaaaaagatgtaacaagaaaaaaaatataaagaccaattttttaagacctatcgaggaagagaaaacggtattaaataattatgtatataaaggtgtaaattttttagatacaataaaaagaaatgattcctcttataaatttgatgtttataaagatacttcctttttaaaaaatagagaatataaagaattaattactatgcagtatgattatgcttatttagaagcaacaaaagaggttctttatttaattccgaaggataaagattatcacaaattttataaaaatgaacttgagaaaattcttttcaatttaaaagattcacttaaattattaagagaaggatatatacaaagcaaactggaaatgattagaatccattcggatatagatatattaaatgagtttcatcaaggaaatattataaacgataattattttaataatgaaataaaaaaaaaaaaggaagacgtggaaaaatatataagagaatataatttatacatatataaatatgaaaatcagcttaaaatagaaatacagaaattaacaaatgaagtttctataaatttaaataaatctacatgtgaaaagaattgttattattatattttaaaattagaaaaatataaaaatataataaaagataagataaataaatggacagatttaccagaaatatatattgatgataaaagtttctcatatacatttttaaaagatgtaataaataataagatagatatatataaaacaataagttcttttatatctactcagaaacaattatattattttgaatatatatatataatgaataaaaatacattaaacctactttcatataatatacaaaaaacagatataaattctagtagtaaatacacatatacaaaatctcattttttaaaagataatcatatattgttatctaaatattatactgccaaatttattgatatcctaaataaaacatattattataatttatataaaaataaaattcttttattcaataaatatattataaagcttagaaacgatttaaaagaatatgcatttaaatctatacaatttattcaagataaaatcaaaaaacataaagatgaattatccatagaaaatatattacaagaagttaataatatatatataaaatatgatacttcgataaatgaaatatctaaatataacaatttaattattaatactgatttacaaatagtacaacaaaaacttttagaaatcaaacaaaaaaaaaatgatattacacacaaagtacaacttataaatcatatatataaaaatatacatgatgaaatattaaacaaaaaaaataatgaaataacaaagattattataaataatataaaagatcataaaaaggatttacaagatctcttactatttatacaacaaatcaaacaatataatatattaacagatcataatattacacaatgtaataattattataaggaaatcataaaaatgaaagaagatataaatcatattcatatatatatacaaccaattctaaataatttacacacattaaaacaagtacaaaataataaaatcaaatatgaagagcacatcaaacaaatattacaaaaaatttatgataaaaaggaatctttaaaaaaaattattctcttaaaagatgaagcacaattagacattaccctcctcgatgacttaatacaaaagcaaacacaaacacaaaaacaaacactaatacaaaataatgagacgattcaacttatttctggacaagaagataaacatgaatccaatccatttaatcatatacaaacctatattcaacaaaaagatacacaaaataaaaacatccaaaatcttcttaaatccttgtataatggaaatattaacacattcatagacacaatttctaaatatatattaaaacaaaaagatatagaattaacacaacacgtttatacagacgaaaaaattaatgattatcttgaagaaataaaaaatgaacaaaacaaaatagataagaccatcgacgatataaaaatacaagaaacattaaaacaaataactcatattgttaacaatataaaaaccatcaaaaaggatttgctcaaagaatttattcaacatttaataaaatatatgaacgaaagatatcagaatatgcaacagggttataataatttaacaaattatattaatcaatatgaagaagaaaataataatatgaaacaatatattactaccatacgaaatatccaaaaaatatattatgataatatatatgctaaggaaaaggaaattcgctcgggacaatattataaggattttatcacatcaaggaaaaatatttataatataagggaaaatatatccaaaaatgtagatatgataaaaaatgaagaaaagaagaaaatacagaattgtgtagataaatataattctataaaacaatatgtaaaaatgtttaaaaatggagacacacaagatgaaaataataataataataatgatatatacgacaagttaattgtcccccttgattcaataaaacaaaatatcgataaatacaacacagaacataattttataacatttacaaataaaataaatacacataataagaagaaccaagaaatgatggaagaattcatatatgtatataaaaggttaaaaattttaaaaatattaaatatatccttaaaagcttgtgaaaaaaataataaatctatcaatacattaaatgacaaaacacaagaattaaaaaaaattgtaacacacgaaatagatcttctacaaaaagatattttaacaagtcaaatatcaaataaaaatgttttattattaaacgatttattaaaagaaattgaacaatatattatagatatacacaaattaaaaaaaaaatcaaacgatctatttacatattatgaacaatccaaaaattatttctattttaaaaacaaaaaagataattttgatatacaaaaaacaatcaataaaatgaatgaatggctagctatcaaaaattatataaatgaaattaataaaaattatcaaacattatatgaaaaaaaaataaatgtactcctacataattcaaaaagttatgtacaatacttttatgatcatataataaatctaattcttcaaaaaaaaaattatttggaaaatactttaaagacaaaaatacaagataacgaacattcactatatgctttacaacaaaatgaagaataccaaaaggtaaagaacgaaaaggatcaaaacgaaattaagaaaattaaacaattaatcgaaaaaaataaaaatgatatacttacatatgaaaacaacattgaacaaattgaacaaaaaaatattgagttaaaaacaaatgctcaaaataaggatgatcaaatagtaaataccttaaatgaggttaagaaaaaaataatatatacatatgaaaaggtagataatcaaatatcgaacgttttaaaaaattatgaagaaggaaaagtagaatatgataaaaatgttgtacaaaatgttaacgatgcggatgatacaaacgatattgatgaaataaacgatattgatgaaataaacgatattgatgaaataaacgatattgatgaaataaaagacattgaccatataaaacattttgacgatacaaaacattttgacgatatataccatgctgatgatacacgtgatgaataccatatagccctttcaaattatataaagacagaactaagaaatataaacctgcaagaaataaaaaacaatataataaaaatatttaaagaattcgaatctgcacacaaagaaattaaaaaagaatcaaaacaaattaataaagaatttaccaaaatggatgtcgtcataaatcaattaagagatatagacagacaaatgcttgatctttataaagaattagatgaaaaatattctgaatttaataaaacaaaaattgaagaaataaataatataagggaaaatattaataatgtggaaatatggtatgaaaaaaatataattgaatatttcttacgttatatgaatgatcaaaaagataaagctgcaaaatatatggaaaacattgatacatataaaaataatattgaaattattagtaaacaaataaatccagaaaattatgttgaaacattaaaaaaaacaaatatgtattcttatgtagaaaaggctaatgatctattttataaacaaataaataatataatcataaattcaaatcaactaaaaaacgaagcttttacaatagatgaattacaaaatattcaaaaaaacagaaaaaatcttcttacaaagaaacaacaaattattcagtatacaaatgaaatagaaaatatatttaatgaaattaaaaatattaataacatattagtcttaacaaattataaatctatccttcaagatatatcacaaaatataaatcatgttagtatatatacggaacaattacataatttatatataaaattagaagaagaaaaagaacaaatgaaaacactctatcataaatcaaatgtgttacataaccaaattaattttaatgaagatgcttttattaataatttattaattaatatagaaaaaattaaaaatgatattacacatataaaggaaaaaacaaatatatatatgatagatgtaaacaaatctaaaaataatgctcaactatattttcataatacactaagaggtaatgaaaaaatagaatatttaaaaaatcttaagaattcaacaaaccaacaaataactttacaagaattaaaacaagtacaagaaaatgttgagaaggtaaaagatatatacaatcaaactataaaatatgaagaaaaaattaaaaaaaattatcatattataacagattatgagaataaaataaatgatattttacataattcatttattaaacaaataaatatggaatctagcaataataaaaaacaaacaaaacaaattatagacataataaacgataaaacatttgaagaacatataaaaacatccaaaaccaaaataaacatgctaaaagaacaatcacaaatgaaacatatagacaaaactttattaaatgaacaagcactcaaattatttgtagatattaattctactaataataatttagataatatgttatctgaaataaattctatacaaaataatatacatacatatatccaagaagcaaacaaatcatttgacaaatttaaaattatatgtgatcaaaatgtaaacgatttattaaacaaattaagtttaggagatctaaattatatgaatcatttaaaaaatctgcaaaacgaaataagaaacatgaatctagaaaaaaatttcatgttagataaaagtaaaaaaatagatgaggaagaaaaaaaattagatatattaaaagttaacatatcaaatataaataattctttagataaattaaaaaaatattacgaagaagcgctctttcaaaaggttaaagaaaaagcagaaattcaaaaggaaaatatagaaaaaataaaacaagaaataaatacactgagcgatgtttttaagaaaccatttttttttatacaacttaatacagattcatcacaacatgaaaaagatataaataataatgtagaaacatataaaaataatatagatgaaatatataatgtttttatacaatcatataatttaatacaaaaatattcttcagaaattttttcatccaccttgaattatatacaaacaaaagaaataaaagaaaaatccataaaggaacaaaaccaattaaatcaaaatgaaaaggaagcatctgttttattaaaaaatataaaaataaatgaaaccataaaattatttaaacaaataaaaaatgaaagacaaaacgatgtacacaatataaaagaggactataacttgttacaacaatatttaaattatatgaaaaatgaaatggaacaattaaaaaaatataaaaatgatgttcatatggataaaaattatgttgaaaataataatggtgaaaaagaaaaattgcttaaagaaaccatttcttcatattatgataaaataaataatataaataataagctatatatatataaaaacaaagaagacacttattttaataatatgatcaaagtttcagaaattttaaacataattataaaaaaaaaacaacaaaatgaacaaagaattgttataaatgcagaatatgactcttcattaattaataaggatgaagaaattaaaaaagaaattaataatcaaataattgaattaaataaacataatgaaaatatttccattatttttaaggatatacaaaatataaaaaaacaaagtcaagatattatcacaaatatgaatgacatgcataaaagtacaatccttttagtagacatcatacagaaaaaagaagaagctctaaataaacaaaaaaatattttaagaaatatagacaatatattaaataaaaaagaaaatattatagataaagttataaaatgtaattgtgatgattataaagatatcttaatacaaaacgaaacggaatatcaaaaattacaaaatataaatcatacatatgaagaaaaaaaaaaatcaatagatatattaaaaattaaaaatataaaacaaaaaaatattcaagaatataaaaacaaattagaacaaatgaatacaataattaatcaaagtatagaacaacatgtattcataaacgctgatattttacaaaatgaaaaaataaaattagaagaaatcataaaaaatctagatatactagatgaacaaattatgacatatcataattcaatagatgaattatataaactaggaatacaatgtgacaatcatctaattacaactattagtgttgttgttaataaaaatacaacaaaaattatgatacatataaaaaaacaaaaagaggatatacaaaaaattaataactatattcaaacaaattataatataataaatgaagaagctctacaatttcacaggctctatggacacaatcttataagtgaagatgacaaaaataatttggtacatattataaaagaacaaaagaatatatatacacaaaaggaaatagatatttctaaaataattaaacatgttaaaaaaggattatattcattgaatgaacatgatatgaatcatgatacacatatgaatataataaatgaacatataaataataatattttacaaccatacacacaattaataaacatgataaaagatattgataatgtttttataaaaatacaaaataataaattcgaacaaatacaaaaatatatagaaattattaaatctttagaacaattaaataaaaatataaacacagataatttaaataaattaaaagatacacaaaacaaattaataaatatagaaacagaaatgaaacataaacaaaaacaattaataaacaaaatgaatgatatagaaaaggataatattacagatcaatatatgcatgatgttcagcaaaatatatttgaacctataacattaaaaatgaatgaatataatacattattaaatgataatcataataataatataaataatgaacatcaatttaatcatttaaatagtcttcatacaaaaatatttagtcataattataataaagaacaacaacaagaatatataaccaacatcatgcaaagaattgatgtattcataaatgatttagatacttaccaatatgaatattatttttatgaatggaatcaagaatataaacaaatagacaaaaataaaataaatcaacatataaacaatattaaaaataatctaattcatgttaagaaacaatttgaacacaccttagaaaatataaaaaataatgaaaatattttcgacaacatacaattgaaaaaaaaagatattgacgatattattataaacattaataatacaaaagaaacatatctaaaagaattgaacaaaaaaaaaatgttacaaaataaaaaaaaagttgatgaaaaatcagaaataaataatcatcacacattacaacatgataatcaaaatgttgaacaaaaaaataaaattaaagatcataatttaataaccaagccaaataacaattcatcagaagaatctcatcaaaatgaacaaatgaaagaacaaaacaaaaatatacttgaaaaacaaacaagaaatatcaaaccacatcatgttcataatcataatcataatcataatcaaaatcaaaaagattcaacaaaattacaggaacaagatatatctacacacaaattacataatactatacatgagcaacaaagtaaagataatcatcaaggtaatagagaaaaaaaacaaaaaaatggaaaccatgaaagaatgtattttgccagtggaatagttgtatccattttatttttatctagtcttggatttgttataaatagtaaaaataataaacaagaatatgataaagagcaagaaaaacaacaacaaaatgattttgtatgtgataataacaaaatggatgataaaagcacacaaaaatatggtagaaatcaagaagaggtaatggagatatcttttgataatgattatatttaa

SEQ ID NO: 35 - DNA, 9049 bp, Plasmodium falciparum
  ref <308>: DATABASE ACCESSION NUMBER: Genbank accession no: AF411929
ttaaaatatgcaaaggtggattttctgcaacattgttttgcatatattaatttacttagcaggtaaaataatataaacatatataaacatatataaacatatataaacatatacatatatatatatgtatattttattttattttatttttttttttttttttccccagaatttagccatgaacaggaaagttattcttccaatgaaaaaataagaaaggactattcagatgataataattatgaacctaccccttcatatgaaaaaagaaaaaaagaatatggaaaagatgaaagttatataaaaaattacagaggtaataatttttcctatgatttgtctaaaaattctagtatatttcttcacatgggtaacggtagtaactcgaaaacactaaaaagatgtaacaagaaaaaaaatataaagaccaattttttaagacctatcgaggaagagaaaacggtattaaataattatgtatataaaggtgtaaattttttagatacaataaaaagaaatgattcctcttataaatttgatgtttataaagatacttcctttttaaaaaatagagaatataaagaattaattactatgcagtatgattatgcttatttagaagcaacaaaagaggttctttatttaattccgaaggataaagattatcacaaattttataaaaataaacttgagaaaattcttttcaatttaaaagattcacttaaattattaagagaaggatatatacaaagcaaactggaaatgattagaatccattcggatatagatatattaaatgagtttcatcaaggaaatattataaacgataattattttaataatgaaataaaaaaaaaaaaggaagacatggaaaaatatataagagaatataatttatacatatataaatatgaaaatcagcttaaaatagaaatacagaaattaacaaatgaagtttctataaatttaaataaatctacatgtgaaaagaattgttattattatattttaaaattagaaaaatataaaaatataataaaagataagataaataaatggaaagatttaccagaaatatatattgatgataaaagtttctcatatacatttttaaaagatgtaataaataataagatagatatatataaaacaataagttcttttatatctactcagaaacaattatattatcttgaatatatatatataatgaataaaaatacattaaacctactttcatataatatacaaaaaacagatataaattctagtagtaaatacacatatacaaaatctcattttttaaaagataatcatatattgttatctaaatattatactgccaaatttattgatatcctaaataaaacatattattataatttatataaaaataaaattcttttattcaataaatatattataaagcttagaaacgatttaaaagaatatgcatttaaatctatacaatttattcaagataaaatcaaaaaacataaagatgaattatccatagaaaatatattacaagaagttaataatatatatataaaatatgatacttcgataaatgaaatatctaaatataacaatttaattattaatactgatttacaaatagtacaacaaaaacttttagaaatcaaacaaaaaaaaaatgatattacacacaaagtacaacttataaatcatatatataaaaatatacatgatgaaatattaaacaaaaaaaataatgaaataacaaagattattataaataatataaaagatcataaaaaggatttacaagatctcttactatttatacaacaaatcaaacaatataatatattaacagatcataatattacacaatgtaataattattataaggaaatcataaaaatgaaagaagatataaatcatattcatatatatatacaaccaattctaaataatttacacacattaaaacaagtacaaaataataaaatcaaatatgaagagcacatcaaacaaatattacaaaaaatttatgataaaaaggaatctttaaaaaaaattattctcttaaaagatgaagcacaattagacattaccctcctcgatgacttaatacaaaagcaaacacaaacacaaacacaaacacaaaaacaaacactaatacaaaataatgagacgattcaacttatttctggacaagaagataaacatgaatccaatccatttaatcatatacaaacctatattcaacaaaaagatacacaaaataaaaacatccaaaatcttcttaaatccttgtataatggaaatattaacacattcatagacacaatttctaaatatatattaaaacaaaaagatatagaattaacacaacacgtttatacagacgaaaaaattaatgattatcttgaagaaataaaaaatgaacaaaacaaaatagataagaccatcgacgatataaaaatacaagaaacattaaaacaaataactcatattgttaacaatataaaaaccatcaaaaaggatttgctcaaagaatttattcaacatttaataaaatatatgaacgaaagatatcagaatatgcaacagggttataataatttaacaaattatattaatcaatatgaagaagaaaataataatatgaaacaatatattactaccatacgaaatatccaaaaaatatattatgataatatatatgctaaggaaaaggaaattcgctcgggacaatattataaggattttatcacatcaaggaaaaatatttataatataagggaaaatatatccaaaaatgtagatatgataaaaaatgaagaaaagaagaaaatacagaattgtgtagataaatataattctataaaacaatatgtaaaaatgtttaaaaatggagacacacaagatgaaaataataataataataatgatatatacgacaagttaattgtcccccttgattcaataaaacaaaatatcgataaatacaacacagaacataattttataacatttacaaataaaataaatacacataataagaagaaccaagaaatgatggaagaattcatatatgtatataaaaggttaaaaattttaaaaatattaaatatatccttaaaagcttgtgaaaaaaataataaatctatcaatacattaaatgacaaaacacaagaattaaaaaaaattgtaacacacgaaatagatcttctacaaaaagatattttaacaagtcaaatatcaaataaaaatgttttattattaaacgatttattaaaagaaattgaacaatatattatagatgtacacaaattaaaaaaaaaatcaaacgatctatttacatattatgaacaatccaaaaattatttctattttaaaaacaaaaaagataattttgatatacaaaaaacaatcaataaaatgaatgaatggctagctatcaaaaattatataaatgaaattaataaaaattatcaaacattatatgaaaaaaaaataaatgtactcctacataattcaaaaagttatgtacaatacttttatgatcatataataaatctaattcttcaaaaaaaaaattatttggaaaatactttaaagacaaaaatacaagataacgaacattcactatatgctttacaacaaaatgaagaataccaaaaggtaaagaacgaaaaggatcaaaacgaaattaagaaaattaaacaattaatcgaaaaaaataaaaatgatatacttacatatgaaaacaacattgaacaaattgaacaaaaaaatattgagttaaaaacaaatgctcaaaataaggatgatcaaatagtaaataccttaaatgaggttaagaaaaaaataatatatacatatgaaaaggtagataatcaaatatcgaacgttttaaaaaattatgaagaaggaaaagtagaatatgataaaaatgttgtacaaaatgttaacgatgcggatgatacaaacgatattgatgaaataaacgatattgatgaaataaacgatattgatgaaataaacgatattgatgaaataaacgatattgatgaaataaaagacattgaccatataaaacattttgacgatacaaaacattttgacgatatataccatgctgatgatacacgtgatgaataccatatagccctttcaaattatataaagacagaactaagaaatataaacctgcaagaaataaaaaacaatataataaaaatatttaaagaattcgaatctgcacacaaagaaattaaaaaagaatcaaaacaaattaataaagaatttaccaaaatggatgtcgtcataaatcaattaagagatatagacagacaaatgcttgatctttataaagaattagatgaaaaatattctgaatttaataaaacaaaaattgaagaaataaataatataagggaaaatattaataatgtggaaatatggtatgaaaaaaatataattgaatatttcttacgtcatatgaatgatcaaaaagataaagctgcaaaatatatggaaaacattgatacatataaaaataatattgaaattattagtaaacaaataaatccagaaaattatgttgaaacattaaacaaatcaaatatgtattcttatgtagaaaaggctaatgatctattttataaacaaataaataatataatcataaattcaaatcaactaaaaaacgaagcttttacaatagatgaattacaaaatattcaaaaaaacagaaaaaatcttcttacaaagaaacaacaaattattcagtatacaaatgaaatagaaaatatatttaatgaaattaaaaatattaataacatattagtcttaacaaattataaatctatccttcaagatatatcacaaaatataaatcatgttagtatatatacggaacaattacataatttatatataaaattagaagaagaaaaagaacaaatgaaaacactctatcataaatcaaatgtgttacataaccaaattaattttaatgaagatgcttttattaataatttattaattaatatagaaaaaattaaaaatgatattacacatataaaggaaaaaacaaatatatatatgatagatgtaaacaaatctaaaaataatgctcaactatattttcataatacactaagaggtaatgaaaaaatagaatatttaaaaaatcttaagaattcaacaaaccaacaaataactttacaagaattaaaacaagtacaagaaaatgttgagaaggtaaaagatatatacaatcaaactataaaatatgaagaaaaaattaaaaaaaattatcatattataacagattacgagaataaaataaatgatattttacataattcatttattaaacaaataaatatggaatctagcaataataaaaaacaaacaaaacaaattatagacataataaacgataaaacatttgaagaacatataaaaacatccaaaaccaaaataaacatgctaaaagaacaatcacaaatgaaacatatagacaaaactttattaaatgaacaagcactcaaattatttgtagatattaattctactaataataatttagataatatgttatctgaaataaattctatacaaaataatatacatacatatatccaagaagcaaacaaatcatttgacaaatttaaaattatatgtgatcaaaatgtaaacgatttattaaacaaattaagtttaggagatctaaattatatgaatcatttaaaaaatctgcaaaacgaaataagaaacatgaatctagaaaaaaatttcatgttagataaaagtaaaaaaatagatgaggaagaaaaaaaattagatatattaaaagttaacatatcaaatataaataattctttagataaattaaaaaaatattacgaagaagcgctctttcaaaaggttaaagaaaaagcagaaaatcaaaaggaaaatatagaaaaaataaaacaagaaataaatacactgagcgatgtttttaagaaaccatttttttttatacaacttaatacagattcatcacaacatgaaaaagatataaacaataatgtagaaacatataaaaataatatagatgaaatatataatgtttttatacaatcatataatttaatacaaaaatattcttcagaaattttttcatccaccttgaattatatacaaacaaaagaaataaaagaaaaatccataaaggaacaaaaccaattaaatcaaaatgaaaaggaagcatttgttttattaaaaaatataaaaataaatgaaaccataaaattatttaaacaaataaaaaatgaaagacaaaacgatgtacacaatataaaagaggactataacttgttacaacaatatttaaattatatgaaaaatgaaatggaacaattaaaaaaatataaaaatgatgttcatatggataaaaattatgttgaaaataataatggtgaaaaagaaaaattacttaaagaaaccatttcttcatattatgataaaataaataatataaataataagctatatatatataaaaacaaagaagacacttattttaataatatgatcaaagtttcagaaattttaaacataattataaaaaaaaaacaacaaaatgaacaaagaattgttataaatgcagaatatgactcttcattaattaataaggatgaagaaattaaaaaagaaattaataatcaaataattgaattaaataaacataatgaaaatatttccaatatttttaaggatatacaaaatataaaaaaacaaagtcaagatattatcacaaatatgaatgacatgcataaaagtacaatccttttagtagacatcatacagaaaaaagaagaagctctaaataaacaaaaaaatattttaagaaatatagacaatatattaaataaaaaagaaaatattatagataaagttataaaatgtaattgtgatgattataaagatatcttaatacaaaacgaaacggaatatcaaaaattacaaaatataaatcatacatatgaagaaaaaaaaaaatcaatagatatattaaaaattaaaaatataaaacaaaaaaatattcaagaatataaaaacaaattagaacaaatgaatacaataattaatcaaagtatagaacaacatgtattcataaacgctgatattttacaaaatgaaaaaataaaattagaagaaatcataaaaaatctagatatactagatgaacaaattatgacatatcataattcaatagatgaattatataaactaggaatacaatgtgacaatcatctaattacaactattagtgttgttgttaataaaaatacaacaaaaattatgatacatataaaaaaacaaaaagaggatatacaaaaaattaataactatattcaaacaaattataatataataaatgaagaagctctacaatttcacaggctctatggacacaatcttataagtgaagatgacaaaaataatttggtacatattataaaagaacaaaagaatatatatacacaaaaggaaatagatatttctaaaataattaaacatgttaaaaaaggattatattcattgaatgaacatgatatgaatcatgatacacatatgaatataataaatgaacatataaataataatattttacaaccatacacacaattaataaacatgataaaagatattgataatgtttttataaaaatacaaaataataaattcgaacaaatacaaaaatatatagaaattattaaatctttagaacaattaaataaaaatataaacacagataatttaaataaattaaaagatacacaaaacaaattaataaatatagaaacagaaatgaaacataaacaaaaacaattaataaacaaaatgaatgatatagaaaaggataatattacagatcaatatatgcatgatgttcagcaaaatatatttgaacctataacattaaaaatgaatgaatataatacattattaaatgatgatcataataataatataaataatgaacatcaatttaatcatttaaatagtcttcatacaaaaatatttagtcataattataataaagaacaacaacaagaatatataaccaacatcatgcaaagaattgatgtattcataaatgatttagatacttaccaatatgaatattatttttatgaatggaatcaagaatataaacaaatagacaaaaataaaataaatcaacatataaacaatattaaaaataatctaattcatgttaagaaacaatttgaacacaccttagaaaatataaaaaataatgaaaatattttcgacaacatacaattgaaaaaaaaagatattgacgatattattataaacattaataatacaaaagaaacatatctaaaagaattgaacaaaaaaaaaatgttacaaaataaaaaaaaagttgatgaaaaatcagaaataaataatcatcacacattacaacatgataatcaaaatgttgaacaaaaaaataaaattaaagatcataatttaataaccaagccaaataacaattcatcagaagaatctcatcaaaatgaacaaatgaaagaacaaaacaaaaatatacttgaaaaacaaacaagaaatatcaaaccacatcatgttcataatcataatcataatcataatcataatcataatcataatcataatcataatcaaaatcaaaaagattcaacaaaattacaggaacaagatatatctacacacaaattacataatactatacatgagcaacaaagtaaagataatcatcaaggtaatagagaaaaaaaacaaaaaaatggaaaccatgaaagaatgtattttgccagtggaatagttgtatccattttatttttatctagtcttggatttgttataaatagtaaaaataataaacaagaatatgataaagagcaagaaaaacaacaacaaaatgattttgtatgtgataataacaaaatggatgataaaagcacacaaaaatatggtagaaatcaagaagaggtaatggagatatcttttgataatgattatatttaaa

SEQ ID NO: 36 - DNA, 5248 bp, Plasmodium falciparum
  ref <308>: DATABASE ACCESSION NUMBER: Genbank accession no: AF432854
atgaataagaatatattgtggataacttttttttattttttattttttctcttggatatgtaccaaggaaatgacgcaattccctcaaaagaaaaaaaaaacgatccagaagcagattctaagaactcacagaatcaacatgatataaataaaacacaccatacgaacaataattatgatctgaatattaaggataaagatgagaaaaaaagaaaaaatgataatttaatcaataattatgattactctcttttaaagttatcttataataagaatcaagatatatataagaatatacaaaatggccaaaagcttaaaacagacataatattaaactcatttgttcaaattaattcatcaaacatattaatggatgaaatagaaaattatgtgaaaaaatatacggaatcgaatcgtattatgtacttacaatttaaatatatatatctacaatccttaaatataacagtatcttttgtacctccgaattcaccatttcgaagttattatgacaaaaatttaaataaagatataaatgaaacttgtcattccatacaaacacttctaaacaatctaatatcttccaaaattatatttaaaatgttagaaactacaaaagaacaaatattacttttatggaataacaaaaaaattagtcaacaaaattataatcaagaaaatcaagaaaaaagtaaaatgatcgattcggaaaatgaaaaactagaaaagtacacaaacaagtttgaacataatatcaaacctcatatagaagatatagagaaaaaagtaaatgaatatattaataattccgattgtcatttaacatgttcaaaatataaaacaattatcaataattatatagatgaaataataacaactaatacaaacatatacgaaaacaaatataatctaccacaagaacgaattatcaaaaactataatcataatggtattaataatgatgataattttatagaatataatattcttaatgcagatcctgatttaagatctcattttataacacttcttgtttcaagaaaacaattaatctatattgaatatatttattttattaacaaacatattgtaaataaaattcaagaaaactttaaattaaatcaaaataaatatatacattttattaattcaaataatgctgttaatgctgctaaagaatatgaatatatcataaaatattatactacattcaaatatctacagacattaaataaatcattatacgactctatatataaacataaaataaataattattctcataacattgaagatcttataaaccaactacaacataaaattaataacctaatgattatctcattcgataaaaataaatcatcagatttaatgttacaatgtacaaatataaaaaaatataccgatgatatatgtttatccattaaacctaaagcattagaagtcgaatatttaagaaatataaataaacacatcaacaaaaatgaattcctaaataaattcatgcaaaacgaaacatttaaaaaaaatatagatgataaaatcaaagaaatgaataatatatacgataatatatatatcatattaaaacaaaaattcttaaacaaattaaacgaaatcatacaaaatcataaaaataaacaagaaacaaaattaaataccacaaccattcaagaattgttacaacttctaaaggatattaaagaaatacaaacaaaacaaatcgatacaaaaattaatacttttaatatgtattataacgatatacaacaaataaaaataaagattaatcaaaatgaaaaagaaataaaaaaggtactccctcaattatatatcccaaaaaatgaacaagaatatatacaaatatataaaaatgaattaaaggatagaataaaagaaacacaaacaaaaattaatttatttaagcaaattttagaattaaaagaaaaagaacattatattacaaacaaacatacatacctaaattttacacacaaaactattcaacaaatattacaacaacaatataaaaacaacacacaagaaaaaaatacactagcacaatttttatacaatgcagatatcaaaaaatatattgatgaattaatacctatcacacaacaaatacaaaccaaaatgtatacaacaaataatatagaacatattaaacaaatactcataaattatatacaagaatgtaaacctatacaaaatatatcagaacatactatttatacactatatcaagaaatcaaaacaaatctggaaaacatcgaacagaaaattatgcaaaatatacaacaaactacaaatcggttaaaaataaatattaaaaaaatatttgatcaaataaatcaaaaatatgacgacttaacaaaaaatataaaccaaatgaatgatgaaaaaattgggttacgacaaatggaaaataggttgaaagggaaatatgaagaaataaaaaaggcaaatcttcaagatagggacataaaatatatagtccaaaataatgatgctaataataataataataatattattattattaatggtaataatcaaaccggtgattataatcacatcttgttcgattatactcacctttgggataatgcacaatttactagaacaaaagaaaatataaacaacctaaaagataatatacaaatcaacataaataatatcaaaagtataataagaaatttacaaaacgaactaaacaattataatactcttaaaagcaattccatccatatttatgataaaatacacacattagaagaattaaaaatattaactcaagaaattaatgataaaaatgttatcagaaaaatatatgatattgaaaccatatatcaaaatgatttacataacatagaagaaattattaaaaatattacaagcatttattacaaaataaatatcttaaatatattaattatttgcatcaaacaaacatataataataataaatccattgaaagcttaaaacttaaaattaataacttaacaaattcaacacaagaatatattaatcaaataaaagctatcccaactaatttattaccagaacatataaaacaaaaaagtgtaagcgaactaaatatttatatgaaacaaatatatgataaattaaatgaacatgttattaataatttatatacaaaatcaaaggattcattacaattttatattaacgaaaaaaattataataataatcatgatgatcataatgatgaccataatgatgtatataatgatatcaaagaaaatgaaatatataaaaataataaattatacgaatgcatacaaatcaaaaaggatgtagacgaattatataatatttatgatcaactctttaaaaatatatcccaaaattataataaccactcccttagttttgtacattcaataaataatcatatgctatctatttttcaagatactaaatatggaaaacacaaaaatcaacaaatcctatccgatatagaaaatattataaaacaaaatgaacacacagaatcatataaaaatttagacacaagtaatatacaactaataaaagaacaaattaaatatttcttacaaatatttcatatacttcaagaaaatataaccactttcgaaaatcaatataaagatttaattatcaaaatgaaccataaaattaataataatctaaaagatattacacatattgtcataaacgataacaatacattacaagaacaaaatcgtatttataacgaacttcaaaacaaaattaaacaaataaaaaatgtcagtgatgtattcacacataatattaattacagtcaacaaatattaaattattctcaagcacaaaatagtttttttaatatatttatgaaatttcaaaacattaataatgatattaatagcaaacgatataatgtacaaaaaaaaattacagagataatcaattcatatgatataataaattataacaaaaataatatcaaagatatttatcaacaattcaaaaatatacaacaacaattaaatacaacagaaacgcaattgaatcatataaaacaaaatattaatcatttcaaatatttttatgaatctcatcaaaccatatctatagtaaagaatatgcaaaatgaaaaactaaaaattcaagaattcaacaaaaaaatacaacacttcaaggaagaaacacaaattatgataaacaagttaatacaacctagccacatacatttacataaaatgaaattgcctataactcaacagcaacttaatacaattcttcatagaaatgaacaaacaaaaaatgctacaagaagttacaatatgaatgaggaggaaaatgaaatgggatatggcataactaataaaaggaaaaatagtgagacaaatgacatgataaataccaccataggagacaagacaaatgtcttaaaaaatgatgatcaagaaaaaggtaaaaggggaacttccagaaataataatattcatacaaatgaaaataatataaataatgaacatacaaatgaaaataatataaataatgaacatacaaatgaaaagaatataaataatgaacatgcaaatgaaaagaatatatataatgaacatacaaatgaaaataatataaattatgaacatccaaataattatcaacaaaaaaatgatgaaaaaatatcactacaacataaaacaattaatacatcacaacgtaccatagatgattcgaatatggatcgaaataatagatataacacatcatcacaacaaaaaaataatttgcatacaaataataatagtaatagtagatacaacaataaccatgataaacaaaatgaacataaatataatcaaggaaaatcttcagggaaagataacgcatattatagaattttttatgctggaggaattacagctgtcttacttttatgttcaagtactgcattcttttttataaaaaactctaatgaaccacatcatatttttaatatttttcaaaaggaatttagtgaagcagataatgcacattcagaagaaaaagaagaatatctacctgtctattttgatgaagttgaagatgaagttgaagatgaagttgaagatgaagatgaaaatgaaaatgaagttgaaaatgaaaatgaagattttaatgacatatgattaatttatataaacattggagagttacattgtgttgttcaaaaataaacaaaaaataaatatttttttttttatttttatccatttggatgatatt

SEQ ID NO: 37 - DNA, 5501 bp, Plasmodium falciparum
  ref <308>: DATABASE ACCESSION NUMBER: Genbank accession no: AF420309
tatataaaaatcgaatttttgttaagaacaaacatttgaaaaaacaaaataaataataataataatataaggtttatatttttctctttattgatttttttctttttcttttttttatttttttcttttttttttttttctttttttctttttcctctgtttatttttttttcttccataaggaatgagtacacccatttaaaataaacatgaataagaatatattgtggataactttttttcattttttattttttctcttgggtaaaaaaaaaatatatataacatatatgatcataagtaaaacgacacacatataatataaacatgtataatatgtaatatatatatatatatatatttatttatttatttatttttacatatatccttcatacacttatatatagatatgtaccaaggaaatgacgcaattccctcaaaagaaaaaaaaaacgatccagaagcagattctaagaactcacagaatcaacatgatataaataaaacacaccatacgaacaataattatgatctgaatattaaggataaagatgagaaaaaaagaaaaaatgataatttaatcaataattatgattactctcttttaaagttatcttataataagaatcaagatatatataagaatatacaaaatggccaaaagcttaaaacagacataatattaaactcatttgttcaaattaattcatcaaacatattaatggatgaaatagaaaattatgtgaaaaaatatacggaatcgaatcgtattatgtacttacaatttaaatatatatatctacaatccttaaatataacagtatcttttgtacctccgaattcaccatttcgaagttattatgacaaaaatttaaataaagatataaatgaaacttgtcattccatacaaacacttctaaacaatctaatatcttccaaaattatatttaaaatgttagaaactacaaaagaacaaatattacttttatggaataacaaaaaaattagtcaacaaaattataatcaagaaaatcaagaaaaaagtaaaatgatcgattcggaaaatgaaaaactagaaaagtacacaaacaagtttgaacataatatcaaacctcatatagaagatatagagaaaaaagtaaatgaatatattaataattccgattgtcatttaacatgttcaaaatataaaacaattatcaataattatatagatgaaataataacaactaatacaaacatatacgaaaacaaatataatctaccacaagaacgaattatcaaaaactataatcataatggtattaataatgatgataattttatagaatataatattcttaatgcagatcctgatttaagatctcattttataacacttcttgtttcaagaaaacaattaatctatattgaatatatttattttattaacaaacatattgtaaataaaattcaagaaaactttaaattaaatcaaaataaatatatacattttattaattcaaataatgctgttaatgctgctaaagaatatgaatatatcataaaatattatactacattcaaatatctacagacattaaataaatcattatacgactctatatataaacataaaataaataattattctcataacattgaagatcttataaaccaactacaacataaaattaataacctaatgattatctcattcgataaaaataaatcatcagatttaatgttacaatgtacaaatataaaaaaatataccgatgatatatgtttatccattaaacctaaagcattagaagtcgaatatttaagaaatataaataaacacatcaacaaaaatgaattcctaaataaattcatgcaaaacgaaacatttaaaaaaaatatagatgataaaatcaaagaaatgaataatatatacgataatatatatatcatattaaaacaaaaattcttaaacaaattaaacgaaatcatacaaaatcataaaaataaacaagaaacaaaattaaataccacaaccattcaagaattgttacaacttctaaaggatattaaagaaatacaaacaaaacaaatcgatacaaaaattaatacttttaatatgtattataacgatatacaacaaataaaaataaagattaatcaaaatgaaaaagaaataaaaaaggtactccctcaattatatatcccaaaaaatgaacaagaatatatacaaatatataaaaatgaattaaaggatagaataaaagaaacacaaacaaaaattaatttatttaagcaaattttagaattaaaagaaaaagaacattatattacaaacaaacatacatacctaaattttacacacaaaactattcaacaaatattacaacaacaatataaaaacaacacacaagaaaaaaatacactagcacaatttttatacaatgcagatatcaaaaaatatattgatgaattaatacctatcacacaacaaatacaaaccaaaatgtatacaacaaataatatagaacatattaaacaaatactcataaattatatacaagaatgtaaacctatacaaaatatatcagaacatactatttatacactatatcaagaaatcaaaacaaatctggaaaacatcgaacagaaaattatgcaaaatatacaacaaactacaaatcggttaaaaataaatattaaaaaaatatttgatcaaataaatcaaaaatatgacgacttaacaaaaaatataaaccaaatgaatgatgaaaaaattgggttacgacaaatggaaaataggttgaaagggaaatatgaagaaataaaaaaggcaaatcttcaagatagggacataaaatatatagtccaaaataatgatgctaatattaataataataataataataatattattattattaatggtaataatcaaaccggtgattataatcacatcttgttcgattatactcacctttgggataatgcacaatttactagaacaaaagaaaatataaacaacctaaaagataatatacaaatcaacataaataatatcaaaagtataataagaaatttacaaaacgaactaaacaattataatactcttaaaagcaattccatccatatttatgataaaatacacacattagaagaattaaaaatattaactcaagaaattaatgataaaaatgttatcagaaaaatatatgatattgaaaccatatatcaaaatgatttacataacatagaagaaattattaaaaatattacaagcatttattacaaaataaatatcttaaatatattaattatttgcatcaaacaaacatataataataataaatccattgaaagcttaaaacttaaaattaataacttaacaaattcaacacaagaatatattaatcaaataaaagctatcccaactaatttattaccagaacatataaaacaaaaaagtgtaagcgaactaaatatttatatgaaacaaatatatgataaattaaatgaacatgttattaataatttatatacaaaatcaaaggattcattacaattttatattaacgaaaaaaattataataataatcatgatgatcataatgatgtatataatgatatcaaagaaaatgaaatatataaaaataataaattatacgaatgcatacaaatcaaaaaggatgtagacgaattatataatatttatgatcaactctttaaaaatatatcccaaaattataataaccactcccttagttttgtacattcaataaataatcatatgctatctatttttcaagatactaaatatggaaaacacaaaaatcaacaaatcctatccgatatagaaaatattataaaacaaaatgaacacacagaatcatataaaaatttagacacaagtaatatacaactaataaaagaacaaattaaatatttcttacaaatatttcatatacttcaagaaaatataaccactttcgaaaatcaatataaagatttaattatcaaaatgaaccataaaattaataataatctaaaagatattacacatattgtcataaacgataacaatacattacaagaacaaaatcgtatttataacgaacttcaaaacaaaattaaacaaataaaaaatgtcagtgatgtattcacacataatattaattacagtcaacaaatattaaattattctcaagcacaaaatagtttttttaatatatttatgaaatttcaaaacattaataatgatattaatagcaaacgatataatgtacaaaaaaaaattacagagataatcaattcatatgatataataaattataacaaaaataatatcaaagatatttatcaacaattcaaaaatatacaacaacaattaaatacaacagaaacgcaattgaatcatataaaacaaaatattaatcatttcaaatatttttatgaatctcatcaaaccatatctatagtaaagaatatgcaaaatgaaaaactaaaaattcaagaattcaacaaaaaaatacaacacttcaaggaagaaacacaaattatgataaacaagttaatacaacctagccacatacatttacataaaatgaaattgcctataactcaacagcaacttaatacaattcttcatagaaatgaacaaacaaaaaatgctacaagaagttacaatatgaatgaggaggaaaatgaaatgggatatggcataactaataaaaggaaaaatagtgagacaaatgacatgataaataccaccataggagacaagacaaatgtcttaaaaaatgatgatcaagaaagaggtaaaaggggaacttccagaaataataatattcatacaaatgaaaataatataaataatgaacatacaaatgaaaataatataaataatgaacatacaaatgaaaagaatataaataatgaacatgcaaatgaaaagaatatatataatgaacatacaaatgaaaataatataaattatgaacatccaaataattatcaacaaaaaaatgatgaaaaaatatcactacaacataaaacaattaatacatcacaacgtaccatagatgattcgaatatggatcgaaataatagatataacacatcatcacaacaaaaaaataatttgcatacaaataataatagtaatagtagatacaacaataaccatgataaacaaaatgaacataaatataatcaaggaaaatcttcagggaaagataacgcatattatagaattttttatgctggaggaattacagctgtcttacttttatgttcaagtactgcattcttttttataaaaaactctaatgaaccacatcatatttttaatatttttcaaaaggaatttagtgaagcagataatgcacattcagaagaaaaagaagaatatctacctgtctattttgatgaagttgaagatgaagttgaagatgaagatgaaaatgaaaatgaagttgaaaatgaaaatgaagattttaatgacatatgattaatttata

SEQ ID NO: 38 - protein, 3254 aa, Plasmodium falciparum
  misc_feature (1)..(3254): Protein of SEQ ID NO: 23
  ref <308>: DATABASE ACCESSION NUMBER: Genbank Accession No. AY138500
MKTTLFCSISFCNIIFFFLELSHEHFVGQSSNTHGASSVTDFNFSEEKNLKSFEGKNNNNDNYASINRLYRKKPYMKRSLINLENDLFRLEPISYIQRYYKKNINRSDIFHNKKERGSKVYSNVSSFHSFIQEGKEEVEVFSIWGSNSVLDHIDVLRDNGTVVFSVQPYYLDIYTCKEAILFTTSFYKDLDKSSITKINEDIEKFNEEIIKNEEQCLVGGKTDFDNLLIVLENAEKANVRKTLFDNTFNDYKNKKSSFYNCLKNKKNDYDKKIKNIKNEITKLLKNIESTGNMCKTESYVMNNNLYLLRVNEVKSTPIDLYLNRAKELLESSSKLVNPIKMKLGDNKNMYSIGYIHDEIKDIIKRYNFHLKHIEKGKEYIKRITQANNIADKMKKDELIKKIFESSKHFASFKYSNEMISKLDSLFIKNEEILNNLFNNIFNIFKKKYETYVDMKTIESKYTTVMTLSEHLLEYAMDVLKANPQKPIDPKANLDSEVVKLQIKINEKSNELDNAISQVKTLIIIMKSFYDIIISEKASMDEMEKKELSLNNYIEKTDYILQTYNIFKSKSNIINNNSKNISSKYITIEGLKNDIDELNSLISYFKDSQETLIKDDELKKNMKTDYLNNVKYIEENVTHINEIILLKDSITQRIADIDELNSLNLININDFINEKNISQEKVSYNLNKLYKGSFEELESELSHFLDTKYLFHEKKSVNELQTILNTSNNECAKLNFMKSDNNNNNNNSNIINLLKTELSHLLSLKENIIKKLLNHIEQNIQNSSNKYTITYTDINNRMEDYKEEIESLEVYKHTIGNIQKEYILHLYENDKNALAVHNTSMQILQYKDAIQNIKNKISDDIKILKKYKEMNQDLLNYYEILDKKLKDNTYIKEMHTASLVQITQYIPYEDKTISELEQEFNNNNQKLDNILQDINAMNLNINILQTLNIGINACNTNNKNVEHLLNKKIELKNILNDQMKIIKNDDIIQDNEKENFSNVLKKEEEKLEKELDDIKFNNLKMDIHKLLNSYDHTKQNIESNLKINLDSFEKEKDSWVHFKSTIDSLYVEYNICNQKTHNTIKQQKNDIIELIYKRIKDINQEIIEKVDNYYSLSDKALTKLKSIHFNIDKEKYKNPKSQENIKLLEDRVMILEKKIKEDKDALIQIKNLSHDHFVNADNEKKKQKEKEEDDEQTHYSKKRKVMGDIYKDIKKNLDELNNKNLIDITLNEANKIESEYEKILIDDICEQITNEAKKSDTIKEKIESYKKDIDYVDVDVSKTRNDHHLNGDKIHDSFFYEDTLNYKAYFDKLKDLYENINKLTNESNGLKSDAHNNNTQVDKLKEINLQVFSNLGNIIKYVEKLENTLHELKDMYEFLETIDINKILKSIHNSMKKSEEYSNETKKIFEQSVNITNQFIEDVEILKTSINPNYESLNDDQIDDNIKSLVLKKEEISEKRKQVNKYITDIESNKEQSDLHLRYASRSIYVIDLFIKHEIINPSDGKNFDIIKVKEMINKTKQVSNEAMEYANKMDEKNKDIIKIENELYNLINNNIRSLKGVKYEKVRKQARNAIDDINNIHSNIKTILTKSKERLDEIKKQPNIKREGDVLNNDKTKIAYITIQINNGRIESNLLNILNMKHNIDTILNKAMDYMNDVSKSDQIVINIDSLNMNDIYNKDKDLLINILKEKQNMEAEYKKMNEMYNYVNETEKEIIKHKKNYEIRIMEHIKKETNEKKKKFMESNNKSLTTLMDSFRSMFYNEYINDYNINENFEKHQNILNEIYNGFNESYNIINTKMTEIINDNLDYNEIKEIKEVAQTEYDKLNKKVDELKNYLNNIKEQEGHRLIDYIKEKIFNLYIKCSEQQNIIDDSYNYITVKKQYIKTIEDVKFLLDSLNTIEEKNKSVANLEICTNKEDIKNLLKHVIKLANFSGIIVMSDTNTEITPENPLEDNDLLNLQLYFERKHEITSTLENDSDLELDHLGSNSDESIDNLKVYNDIIELHTYSTQILKYLDNIQKLKGDCNDLVKDCKELRELSTALYDLKIQITSVINRENDISNNIDIVSNKLNEIDAIQYNFEKYKEIFDNVEEYKTLDDTKNAYIVKKAEILKNVDINKTKEDLDIYFNDLDELEKSLTLSSNEMEIKTIVQNSYNSFSDINKNINDIDKEMKTLIPMLDELLNEGHNIDISLYNFIIRNIQIKIGNDIKNIREQENDTNICFEYIQNNYNFIKSDISIFNKYDDHIKVDNYISNNIDVVNKHNSLLSEHVINATNIIENIMTSIVEINEDTEMNSLEETQDKLLELYENFKKEKNIINNNYKIVHFNKLKEIENSLETYNSISTNFNKINETQNIDILKNEFNNIKTKINDKVKELVHVDSTLTLESIQTFNNLYGDLMSNIQDVYKYEDINNVELKKVKLYIENITNLLGRINTFIKELDKYQDENNGIDKYIEINKENNSYIIKLKEKANNLKENFSKLLQNIKRNETELYNINNIKDDIMNTGKSVNNIKQKFSSNLPLKEKLFQMEEMLLNINNIMNETKRISNTDAYTNITLQDIENNKNKENNNMNIETIDKLIDHIKIHNEKIQAEILIIDDAKRKVKEITDNINKAFNEITENYNNENNGVIKSAKNIVDKATYLNNELDKFLLKLNELLSHNNNDIKDLGDEKLILKEEEERKERERLEKAKQEEERKERERIEKEKQEKERLEREKQEQLKKEALKKQEQERQEQQQKEEALKRQEQERLQKEEELKRQEQERLEREKQEQLQKEEELRKKEQEKQQQRNIQELEEQKKPEIINEALVKGDKILEGSDQRNMELSKPNVSMDNTNNSPISNSEITESDDIDNSENIHTSHMSDIESTQTSHRSNTHGQQISDIVEDQITHPSNIGGEKITHNDEISITGERNNISDVNDYSESSNIFENGDSTINTSTRNTSSTHDESHISPISNAYDHVVSDNKKSMDENIKDKLKIDESITTDEQIRLDDNSNIVRIDSTDQRDASSHGSSNRDDDEISHVGSDIHMDSVDIHDSIDTDENADHRHNVNSVDSLSSSDYTDTQKDFSSIIKDGGNKEGHAENESKEYESQTEQTHEEGIMNPNKYSISEVDGIKLNEEAKHKITEKLVDIYPSTYRTLDEPMETHGPNEKFHMFGSPYVTEEDYTEKHDYDKHEDFNNERYSNHNKMDDFVYNAGGVVCCVLFFASITFFSMDRSNKDECDFDMCEEVNNNDHLSNYADKEEIIEIVFDENEEKYF

SEQ ID NO: 39 - protein, 3256 aa, Plasmodium falciparum
  misc_feature (1)..(3256): Protein of SEQ ID NO: 24
  ref <308>: DATABASE ACCESSION NUMBER: Genbank Accession No. AY138501
MKTTLFCSISFCNIIFFFLELSHEHFVGQSSNTHGASSVTDFNFSEEKNLKSFEGKNNNNDNYASINRLYRKKPYMKRSLINLENDLFRLEPISYIQRYYKKNINRSDIFHNKKERGSKVYSNVSSFHSFIQEGKEEVEVFSIWGSNSVLDHIDVLRDNGTVVFSVQPYYLDIYTCKEAILFTTSFYKDLDKSSITKINEDIEKFNEEIIKNEEQCLVGGKTDFDNLLIVLENAEKANVRKTLFDNKFKDYKNKKSSFYNCLKNKKNDYDKKINNIKNEITKLLKNIEGTGKMCKTESYVMNNNLYLLRVNEVKSTPIDLYLNRAKELLESSSKLVNPIKMKLGDNKNMYSIGYIHDEIKDIIKRYNFHLKHIEKGKEYIKRITQANNIADKMKKDELIKKIFESSKHFASFKYSNEMISKLDSLFIKNEQILNNLFNNIFNIFKKKYETYVDMKTIESKYTTVMTLSEHLLEYAMDVLKANPQKPIDPKANLDSEVVKLQIKINEKSNELDNAISQVNTLIIIMKSFYDIIISEKASMDEMEKKELSLNNYIEKTDYILQTYDIFKSKSNIINNNSKNISSKYIIIEGLKNYIDELNSLISDFKDSQETLIKDDELKKNMKTDYLNNVKYIEENVTHINEIILLKHSINQRIADIDELNSLNLININDFINEKNISQEKVSYNLNKLYKGSFEELESELSHFLDTKYLFHEKKSVNELQTILNTSNNECAKLNFMKSDNNNNNNNNNSNIINLLKTELSHLLSLKENIIKKLLNHIEQNIQNSSNKYTITYTDINNRMEDYKEEIESLEVYKHTIGNIQKEYILHLYENDKNALAVHNTSMQILQYKDAIQNIKNKISDDIKILKKYKEMNQDLLNYYEILDKKLKDNTYIKEMHTASLVQITQYIPYEDKTISELEQEFNNNNQKLDNILQDINAMNLNINILQTLNIGINACNTNNKNVEHLLNKKIELKNILNDQMKIIKNDDIIQDNEKENFSNVLKKEEEKLEKELDDIKFNNLKMDIHKLLNSYDHTKQNIESNLKINLDSFEKEKDSWVHFKSTIDSLYVEYNICNQKTHNTIKQQKNDIIELIYKRIKDINQEIIEKVDNYYSLSDKALTKLKSIHFNIDKEKYKNPKSQENIKLLEDRVMILEKKIKEDKDALIQIKNLSHDHFVNADNEKKKQKEKEEDDEQTHYSKKRKVMGDIYKDIKKNLDELNNKNLIDITLNEANKIESEYEKILIDDICEQITNEAKKSDTIKEKIESYKKDIDYVDVDVSKTRNDHHLNGDKIHDSFFYEDTLNYKAYFDKLKDLYENINKLTNESNGLKSDAHNNNTQVDKLKEINLQVFSNLGNIIKYVEKLENTLHELKDMYEFLETIDINKILKSIHNSMKKSEEYSNETKKIFEQSVNITNQFIEDVEILKTSINPNYESLNDDQIDDNIKSLVLKKEEISEKRKQVNKYITDIESNKEQSDLHLRYASRSIYVIDLFIKHEIINPSDGKNFDIIKVKEMINKTKQVSNEAMEYANKMDEKNKDIIKIENELYNLINNNIRSLKGVKYEKVRKQARNAIDDINNIHSNIKTILTKSKERLDEIKKQPNIKREGDVLNNDKTKIAYITIQINNGRIESNLLNILNMKHNIDTILNKAMDYMNDVSKSDQIVINIDSLNMNDIYNKDKDLLINILKEKQNMEAEYKKMNEMYNYVNETEKEIIKHKKNYEIRIMEHIKKETNEKKKKFMESNNKSLTTLMDSFRSMFYNEYINDYNINENFEKHQNILNEIYNGFNESYNIINTKMTEIINDNLDYNEIKEIKEVAQTEYDKLNKKVDELKNYLNNIKEQEGHRLIDYIKEKIFNLYIKCSEQQNIIDDSYNYITVKKQYIKTIEDVKFLLDSLNTIEEKNKSVANLEICTNKEDIKNLLKHVIKLANFSGIIVMSDTNTEITPENPLEDNDLLNLQLYFERKHEITSTLENDSDLELDHLGSNSDESIDNLKVYNDIIELHTYSTQILKYLDNIQKLKGDCNDLVKDCKELRELSTALYDLKIQITSVINRENDISNNIDIVSNKLNEINAIQYNFEKYKEIFDNVEEYKTLDDTKNAYIVKKAEILKNVDINKTKEDLDIYFNDLDELEKSLTLSSNEMEIKTIVQNSYNSFSDINKNINDIDKEMKTLIPMLDELLNEGHNIDISLYNFIIRNIQIKIGNDIKNIREQENDTNICFEYIQNNYNFIKSDISIFNKYDDHIKVDNYISNNIDVVNKHNSLLSEHVINATNIIENIMTSIVEINEDTEMNSLEETQDKLLELYENFKKEKNIINNNYKIVHFNKLKEIENSLETYNSISTNFNKINETQNIDILKNEFNNIKTKINDKVKELVHVDSTLTLESIQTFNNLYGDLMSNIQDVYKYEDINNVELKKVKLYIENITNLLGRINTFIKELDKYQDENNGIDKYIEINKENNSYIIKLKEKANNLKENFSKLLQNIKRNETELYNINNIKDDIMNTGKSVNNIKQKFSSNLPLKEKLFQMEEMLLNINNIMNETKRISNTAAYTNITLQDIENNKNKENNNMNIETIDKLIDHIKIHNEKIQAEILIIDDAKRKVKEITDNINKAFNEITENYNNENNGVIKSAKNIVDEATYLNNELDKFLLKLNELLSHNNNDIKDLGDEKLILKEEEERKERERLEKAKQEEERKERERIEKEKQEKERLEREKQEQLKKEALKKQEQERQEQQQKEEALKRQEQERLQKEEELKRQEQERLEREKQEQLQKEEELRKKEQEKQQQRNIQELEEQKKPEIINEALVKGDKILEGSDQRNMELSKPNVSMDNTNNSPISNSEITESDDIDNSENIHTSHMSDIESTQTSHRSNTHGQQISDIVEDQITHPSNIGGEKITHNDEISITGERNNISDVNDYSESSNIFENGDSTINTSTRNTSSTHDESHISPISNAYDHVVSDNKKSMDENIKDKLKIDESITTDEQIRLDDNSNIVRIDSTDQRDASSHGSSNRDDDEISHVGSDIHMDSVDIHDSIDTDENADHRHNVNSVDSLSSSDYTDTQKDFSSIIKDGGNKEGHAENESKEYESQTEQTHEEGIMNPNKYSISEVDGIKLNEEAKHKITEKLVDIYPSTYRTLDEPMETHGPNEKFHMFGSPYVTEEDYTEKHDYDKHEDFNNERYSNHNKMDDFVYNAGGVVCCVLFFASITFFSMDRSNKDECDFDMCEEVNNNDHLSNYADKEEIIEIVFDENEEKYF

SEQ ID NO: 40 - protein, 3203 aa, Plasmodium falciparum
  misc_feature (1)..(3203): Protein of SEQ ID NO: 25
  ref <308>: DATABASE ACCESSION NUMBER: Genbank Accession No. AY138502
MKITLFCSISFCNIIFFFLELSHEHFVGQSSNTHGASSVTDFNFSEEKNLKSFEGKNNNNDNYASINRLYRKKPYMKRSLINLENDLFRLEPISYIQRYYKKNINRSDIFHNKKERGSKVYSNVSSFHSFIQEGKEEVEVFSIWGSNSVLDHIDVLRDNGTVVFSVQPYYLDIYTCKEAILFTTSFYKDLDKSSITKINEDIEKFNEEIIKNEEQCLVGGKTDFDNLLIVLENAEKANVRKTLFDNKFNDYKNKKSSFYNCLKNKKNDYDKKINNIKNEITKLLKNIESTGNMCKTESYVMNNNLYLLRVNEVKSTPIDLYLNRAKELLESSSKLVNPIKMKLGDNKNMYSIGYIHDEIKDIIKRYNFHLKHIEKGKEYIKRITQANNIADKMKKDELIKKIFESSKHFASFKYSNEMISKLDSLFIKNEQILNNLFNNIFNIFKKKYETYVDMKTIESKYTTVMTLSEHLLEYAMDVLKANPQKPIDPKANLDSEVVKLQIKINEKSNELDNAISQVNTLIIIMKSFYDIIISEKASMDEMEKKELSLNNYIEKTDYILQTYGIFKSKSNIINNNSKNISSKYIIIEGLKNDIDELNSLISYFKDSQETLIKDDELKKNMKTDYLNNVKYIEENVTHINEIILLKDSITQRIADIDELNSLNLININDFINEKNISQEKVSYNLNKLYKGSFEELESELSHFLDTKYLFHEKKSVNELQTILNTSNNECAKLNFMKSDNNNNNNNNSNIINLLKTELSHLLSLKENIIKKLLNHIEQNIQNSSNKYTITYTDINNRMEDYKEEIESLEVYKHTIGNIQKEYILHLYENDKNALAVHNTSMQILQYKDAIQNIKNKISDDIKILKKYKEMNQDLLNYYEILDKKLKDNTYIKEMHTASLVQITQYIPYEDKTISELEQEFNNNNQKLDNILQDINAMNLNINILQTLNIGINACNTNNKNVEHLLNKKIELKNILNDQMKIIKNDDIIQDNEKENFSNVLKKEEEKLEKELDDIKFNNLKMDIHKLLNSYDHTKQNIESNLKINLDSFEKEKDSWVHFKSTIDSLYVEYNICNQKTHNTIKQQKNDIIELIYKRIKDINQEIIEKVDNYYSLSDKALTKLKSIHFNIDKEKYKNPKSQENIKLLEDRVMILEKKIKEDKDALIQIKNLSHDHFVNADNEKKKQKEKEEDDEQTHYSKKRKVMGDIYKDIKKNLDELNNKNLIDITLNEANKIESEYEKILIDDICEQITNEAKKSDTIKEKIESYKKDIDYVDVDVSKTRNDHHLNGDKIHDSFFYEDTLNYKAYFDKLKDLYENINKLTNESNGLKSDAHNNNTQVDKLKEINLQVFSNLGNIIKYVEKLENTLHELKDMYEFLETIDINKILKSIHNSMKKSEEYSNETKKIFEQSVNITNQFIEDVEILKTSINPNYESLNDDQIDDNIKSLVLKKEEISEKRKQVNKYITDIESNKEQSDLHLRYTSRSIYVIDLFIKHEIINPSDGKNFDIIKVKEMINKTKQVSNEAMEYANKMDEKNKDIIKIENELYNLINNNIRSLKGVKYEKVRKQARNAIDDINNIHSNIKTILTKSKERLDEIKKQPNIKREGDVLNNDKTKIAYITIQINNGRIESNLLNILNMKHNIDTILNKAMDYMNDVSKSDQIVINIDSLNMNDIYNKDKDLLINILKEKQNMEAEYKKMNEMYNYVNETEKEIIKHKKNYEIRIMEHIKKETNEKKKKFMESNNKSLTTLMDSFRSMFYNEYINDYNINENFEKHQNILNEIYNGFNESYNIINTKMTEIINDNLDYNEIKEIKEVAQTEYDKLNKKVDELKNYLNNIKEQEGHRLIDYIKEKIFNLYIKCSEQQNIIDDSYNYITVKKQYIKTIEDVKFLLDSLNTIEEKNKSVANLEICTSKEDIKNLLKHVIKLANFSGIIVMSDTNTEITPENPLEDNDLLNLQLYFERKHEITSTLENDSDLELDHLGSNSDESIDNLKVYNDIIELHTYSTQILKYLDNIQKLKGDCNDLVKDCKELRELSTALYDLKIQITSVINRENDISNNIDIVSNKLNEIDAIQYNFEKYKEIFDNVEEYKTLDDTKNAYIVKKAEILKNVDINKTKEDLDIYFNDLDELEKSLTLSSNEMEIKTIVQNSYNSFSDINKNINDIDKEMKTLIPMLDELLNEGHNIDISLYNFIIRNIQIKIGNDIKNIREQENDTNICFEYIQNNYNFIKSDISIFNKYDDHIKVDNYISNNIDVVNKHNSLLSEHVINATNIIENIMTSIVEINEDTEMNSLEETQDKLLELYENFKKEKNIINNNYKIVHFNKLKEIENSLETYNSISTNFNKINETQNIDILKNEFNNIKTKINDKVKELVHVDSTLTLESIQTFNNLYGDLMSNIQDVYKYEDINNVELKKVKLYIENITNLLGRINTFIKELDKYQDENNGIDKYIEINKENNSYIIKLKEKANNLKENFSKLLQNIKRNETELYNINNIKDDIMNTGKSVNNIKQKFSSNLPLKEKLFQMEEMLLNINNIMNETKRISNTDAYTNITLQDIENNKNKENNNMNIETIDKLIDHIKIHNEKIQAEILIIDDAKRKVKEITDNINKAFNEITENYNNENNGVIKSAKNIVDEATYLNNELDKFLLKLNELLSHNNNDIKDLGDEKLILKEEEERKERERLEKAKQEEERKERERIEKEKQEKERLEREKQEQLQKEEELKRQEQEKQQQRNIQELEEQKKPEIINEALVKGDKILEGSDQRNMELSKPNVSMDNTNNSPISNSEITESDDIDNSENIHTSHMSDIESTQTSHRSNTHGQQISDIVEDQITHPSNIGGEKITHNDEISITGERNNISDVNDYSESSNIFENGDSTINTSTRNTSSTHDESHISPISNAYDHVVSDNKKSMDENIKDKLKIDESITTDEQIRLDDNSNIVRIDSTDQRDASSHGSSNRDDDEISHVGSDIHMDSVDIHDSIDTDENADHRHNVNSVDSLSSSDYTDTQKDFSSIIKDGGNKEGHAENESKEYESQTEQTHEEGIMNPNKYSISEVDGIKLNEEAKHKITEKLVDIYPSTYRTLDEPMETHGPNEKFHMFGSPYVTEEDYTEKHDYDKHEDFNNERYSNHNKMDDFVYTAGGVVCCVLFFASITFFSMDRSNKDECDFDMCEEVYNNDHLSNYADKEEIIEIVFDENEEKYF

SEQ ID NO: 41 - protein, 3203 aa, Plasmodium falciparum
  misc_feature (1)..(3203): Protein of SEQ ID NO: 26
  ref <308>: DATABASE ACCESSION NUMBER: Genbank Accession No. AY138503
MKTTLFCSISFCNIIFFFLELSHEHFVGQSSNTHGASSVTDFNFSEEKNLKSFEGKNNNNDNYASINRLYRKKPYMKRSLINLENDLFRLEPISYIQRYYKKNINRSDIFHNKKERGSKVYSNVSSFHSFIQEGKEEVEVFSIWGSNSVLDHIDVLRDNGTVVFSVQPYYLDIYTCKEAILFTTSFYKDLDKSSITKINEDIEKFNEEIIKNEEQCLVGGKTDFDNLLIVLENAEKANVRKTLFDNTFNDYKNKKSSFYNCLKNKKNDYDKKINNIKNEITKLLKNIEGTGKMCKTESYVMNNNLYLLRVNEVKSTPIDLYLNRAKELLESSSKLVNPIKMKLGDNKNMYSIGYIHDEIKDIIKRYNFHLKHIEKGKEYIKRITQANNIADKMKKDELIKKIFESSKHFASFKYSNEMISKLDSLFIKNEQILNNLFNNIFNIFKKKYETYVDMKTIESKYTTVMTLSEHLLEYAMDVLKANPQKPIDPKANLDSEVVKLQIKINEKSNELDNAISQVNTLIIIMKSFYDIIISEKASMDEMEKKELSLNNYIEKTDYILQTYGIFKSKSNIINNNSKNISSKYIIIEGLKNDIDELNSLISYFKDSQETLIKDDELKKNMKTDYLNNVKYIEENVTHINEIILLKDSITQRIADIDELNSLNLININDFINEKNISQEKVSYNLNKLYKGSFEELESELSHFLDTKYLFHEKKSVNELQTILNTSNNECAKLNFMKSDNNNNNNNNSNIINLLKTELSHLLSLKENIIKKLLNHIEQNIQNSSNKYTITYTDINNRMEDYKEEIESLEVYKHTIGNIQKEYILHLYENDKNALAVHNTSMQILQYKDAIQNIKNKISDDIKILKKYKEMNQDLLNYYEILDKKLKDNTYIKEMHTASLVQITQYIPYEDKTISELEQEFNNNNQKLDNILQDINAMNLNINILQTLNIGINACNTNNKNVEHLLNKKIELKNILNDQMKIIKNDDIIQDNEKENFSNVLKKEEEKLEKELDDIKFNNLKMDIHKLLNSYDHTKQNIESNLKINLDSFEKEKDSWVHFKSTIDSLYVEYNICNQKTHNTIKQQKNDIIELIYKRIKDINQEIIEKVDNYYSLSDKALTKLKSIHFNIDKEKYKNPKSQENIKLLEDRVMILEKKIKEDKDALIQIKNLSHDHFVNADNEKKKQKEKEEDDEQTHYSKKRKVMGDIYKDIKKNLDELNNKNLIDITLNEANKIESEYEKILIDDICEQITNEAKKSDTIKEKIESYKKDIDYVDVDVSKTRNDHHLNGDKIHDSFFYEDTLNYKAYFDKLKDLYENINKLTNESNGLKSDAHNNNTQVDKLKEINLQVFSNLGNIIKYVEKLENTLHELKDMYEFLETIDINKILKSIHNSMKKSEEYSNETKKIFEQSVNITNQFIEDVEILKTSINPNYESLNDDQIDDNIKSLVLKKEEISEKRKQVNKYITDIESNKEQSDLHLRYASRSIYVIDLFIKHEIINPSDGKNFDIIKVKEMINKTKQVSNEAMEYANKMDEKNKDIIKIENELYNLINNNIRSLKGVKYEKVRKQARNAIDDINNIHSNIKTILTKSKERLDEIKKQPNIKREGDVLNNDKNKIAYITIQINNGRIESNLLNILNMKHNIDTILNKAMDYMNDVSKSDQIVINIDSLNMNDIYNKDKDLLINILKEKQNMEAEYKKMNEMYNYVNETEKEIIKHKKNYEIRIMEHIKKETNEKKKKFMESNNKSLTTLMDSFRSMFYNEYINDYNINENFEKHQNILNEIYNGFNESYNIINTKMTEIINDNLDYNEIKEIKEVAQTEYDKLNKKVDELKNYLNNIKEQEGHRLIDYIKEKIFNLYIKCSEQQNIIDDSYNYITVKKQYIKTIEDVKFLLDSLNTIEEKNKSVANLEICTSKEDIKNLLKHVIKLANFSGIIVMSDTNTEITPENPLEDNDLLNLQLYFERKHEITSTLENDSDLELDHLGSNSDESIDNLKVYNDIIELHTYSTQILKYLDNIQKLKGDCNDLVKDCKELRELSTALYDLKIQITSVINRENDISNNIDIVSNKLNEIDAIQYNFEKYKEIFDNVEEYKTLDDTKNAYIVKKAEILKNVDINKTKEDLDIYFNDLDELEKSLTLSSNEMEIKTIVQNSYNSFSDINKNINDIDKEMKTLIPMLDELLNEGHNIDISLYNFIIRNIQIKIGNDIKNIREQENDTNICFEYIQNNYNFIKSDISIFNKYDDHIKVDNYISNNIDVVNKHNSLLSEHVINATNIIENIMTSIVEINEDTEMNSLEETQDKLLELYENFKKEKNIINNNYKIVHFNKLKEIENSLETYNSISTNFNKINETQNIDILKNEFNNIKTKINDKVKELVHVDSTLTLESIQTFNNLYGDLMSNIQDVYKYEDINNVELKKVKLYIENITNLLGRINTFIKELDKYQDENNGIDKYIEINKENNSYIIKLKEKANNLKENFSKLLQNIKRNETELYNINNIKDDIMNTGKSVNNIKQKFSSNLPLKEKLFQMEEMLLNINNIMNETKRISNTDAYTNITLQDIENNKNKENNNMNIETIDKLIDHIKIHNEKIQAEILIIDDAKRKVKEITDNINKAFNEITENYNNENNGVIKSAKNIVDEATYLNNELDKFLLKLNELLSHNNNDIKDLGDEKLILKEEEERKERERLEKAKQEEERKERERIEKEKQEKERLEREKQEQLQKEEELKRQEQEKQQQRNIQELEEQKKPEIINEALVKGDKILEGSDQRNMELSKPNVSMDNTNNSPISNSEITESDDIDNSENIHTSHMSDIESTQTSHRSNTHGQQISDIVEDQITHPSNIGGEKITHNDEISITGERNNISDVNDYSESSNIFENGDSTINTSTRNTSSTHDESHISPISNAYDHVVSDNKKSMDENIKDKLKIDESITTDEQIRLDDNSNIVRIDSTDQRDASSHGSSNRDDDEISHVGSDIHMDSVDIHDSIDTDENADHRHNVNSVDSLSSSDYTDTQKDFSSIIKDGGNKEGHAENESKEYESQTEQTHEEGIMNPNKYSISEVDGIKLNEEAKHKITEKLVDIYPSTYRTLDEPMETHGPNEKFHMFGSPYVTEEDYTEKHDYDKHEDFNNERYSNHNKMDDFVYTAGGVVCCVLFFASITFFSMDRSNKDECDFDMCEEVYNNDHLSNYADKEEIIEIVFDENEEKYF

SEQ ID NO: 42 - protein, 3130 aa, Plasmodium falciparum; identical to SEQ ID NO: 11
  misc_feature (1)..(3130): Protein of SEQ ID NO: 27
  ref <308>: DATABASE ACCESSION NUMBER: Genbank Accession No. AY138496

SEQ ID NO: 43 - protein, 3096 aa, Plasmodium falciparum
  misc_feature (1)..(3096): Protein of SEQ ID NO: 28
  ref <308>: DATABASE ACCESSION NUMBER: Genbank Accession No. AY138497
MKTTLFCSISFCNIIFFFLELSHEHFVGQSSNTHGASSVTDFNFSEEKNLKSFEGKNNNNDNYASINRLYRKKPYMKRSLINLENDLFRLEPISYIQRYYKKNINRSDIFHNKKERGSKVYSNVSSFHSFIQEGKEEVEVFSIWGSNSVLDHIDVLRDNGTVVFSVQPYYLDIYTCKEAILFTTSFYKDLDKSSITKINEDIEKFNEEIIKNEEQCLVGGKTDFDNLLIVLENAEKANVRKTLFDNKFKDYKNKKSSFYNCLKNKKNDYDKKINNIKNEITKLLKNIEGTGKMCKTESYVMNNNLYLLRVNEVKSTPIDLYLNRAKELLESSSKLVNPIKMKLGDNKNMYSIGYIHDEIKDIIKRYNFHLKHIEKGKEYIKRITQANNIADKMKKDELIKKIFESSKHFASFKYSNEMISKLDSLFIKNEQILNNLFNNIFNIFKKKYETYVDMKTIESKYTTVMTLSEHLLEYAMDVLKANPQKPIDPKANLDSEVVKLQIKINEKSNELDNAISQVNTLIIIMKSFYDIIISEKASMDEMEKKELSLNNYIEKTDYILQTYDIFKSKSNIINNNSKNISSKYIIIEGLKNYIDELNSLISDFKDSQETLIKDDELKKNMKTDYLNNVKYIEENVTHINEIILLKHSINQRIADIDELNSLNLININDFINEKNISQEKVSYNLNKLYKGSFEELESELSHFLDTKYLFHEKKSVNELQTILNTSNNECAKLNFMKSDNNNNNNNNNSNIINLLKTELSHLLSLKENIIKKLLNHIEQNIQNSSNKYTITYTDINNRMEDYKEEIESLEVYKHTIGNIQKEYILHLYENDKNALAVHNTSMQILQYKDAIQNIKNKISDDIKILKKYKEMNQDLLNYYEILDKKLKDNTYIKEMHTASLVQITQYIPYEDKTISELEQEFNNNNQKLDNILQDINAMNLNINILQTLNIGINACNTNNKNVEHLLNKKIELKNILNDQMKIIKNDDIIQDNEKENFSNVLKKEEEKLEKELDDIKFNNLKMDIHKLLNSYDHTKQNIESNLKINLDSFEKEKDSWVHFKSTIDSLYVEYNICNQKTHNTIKQQKNDIIELIYKRIKDINQEIIEKVDNYYSLSDKALTKLKSIHFNIDKEKYKNPKSQENIKLLEDRVMILEKKIKEDKDALIQIKNLSHDHFVNADNEKKKQKEKEEDDEQTHYSKKRKVMGDIYKDIKKNLDELNNKNLIDITLNEANKIESEYEKILIDDICEQITNEAKKSDTIKEKIESYKKDIDYVDVDVSKTRNDHHLNGDKIHDSFFYEDTLNYKAYFDKLKDLYENINKLTNESNGLKSDAHNNNTQVDKLKEINLQVFSNLGNIIKYVEKLENTLHELKDMYEFLETIDINKILKSIHNSMKKSEEYSNETKKIFEQSVNITNQFIEDVEILKTSINPNYESLNDDQIDDNIKSLVLKKEEISEKRKQVNKYITDIESNKEQSDLHLRYASRSIYVIDLFIKHEIINPSDGKNFDIIKVKEMINKTKQVSNEAMEYANKMDEKNKDIIKIENELYNLINNNIRSLKGVKYEKVRKQARNAIDDINNIHSNIKTILTKSKERLDEIKKQPNIKREGDVLNNDKTKIAYITIQINNGRIESNLLNILNMKHNIDTILNKAMDYMNDVSKSDQIVINIDSLNMNDIYNKDKDLLINILKEKQNMEAEYKKMNEMYNYVNETEKEIIKHKKNYEIRIMEHIKKETNEKKKKFMESNNKSLTTLMDSFRSMFYNEYINDYNINENFEKHQNILNEIYNGFNESYNIINTKMTEIINDNLDYNEIKEIKEVAQTEYDKLNKKVDELKNYLNNIKEQEGHRLIDYIKEKIFNLYIKCSEQQNIIDDSYNYITVKKQYIKTIEDVKFLLDSLNTIEEKNKSVANLEICTNKEDIKNLLKHVIKLANFSGIIVMSDTNTEITPENPLEDNDLLNLQLYFERKHEITSTLENDSDLELDHLGSNSDESIDNLKVYNDIIELHTYSTQILKYLDNIQKLKGDCNDLVKDCKELRELSTALYDLKIQITSVINRENDISNNIDIVSNKLNEINAIQYNFEKYKEIFDNVEEYKTLDDTKNAYIVKKAEILKNVDINKTKEDLDIYFNDLDELEKSLTLSSNEMEIKTIVQNSYNSFSDINKNINDIDKEMKTLIPMLDELLNEGHNIDISLYNFIIRNIQIKIGNDIKNIREQENDTNICFEYIQNNYNFIKSDISIFNKYDDHIKVDNYISNNIDVVNKHNSLLSEHVINATNIIENIMTSIVEINEDTEMNSLEETQDKLLELYENFKKEKNIINNNYKIVHFNKLKEIENSLETYNSISTNFNKINETQNIDILKNEFNNIKTKINDKVKELVHVDSTLTLESIQTFNNLYGDLMSNIQDVYKYEDINNVELKKVKLYIENITNLLGRINTFIKELDKYQDENNGIDKYIEINKENNSYIIKLKEKANNLKENFSKLLQNIKRNETELYNINNIKDDIMNTGKSVNNIKQKFSSNLPLKEKLFQMEEMLLNINNIMNETKRISNTDAYTNITLQDIENNKNKENNNMNIETIDKLIDHIKIHNEKIQAEILIIDDAKRKVKEITDNINKAFNEITENYNNENNGVIKSAKNIVDEATYLNNELDKFLLKLNELLSHNNNDIKDLGDEKLILKEEEERKERERLEKAKQEEERKERERLEKAKQEEERKERERIEKEKQEKERLEREKQEQLKKEALKKQEQERQEQQQKEEALKRQEQERLQKEEELKRQEQERLEREKQEQLQKEEELKRQEQERLQKEEALKRQEQERLQKEEELKRQEQERLERKKIELAEREQHIKSKLESDMVKIIKDELTKEKDEIIKNKDIKLRHSLEQKWLKHLQNILSLKIDSLLNKNDEVIKDNETQLKTNILNSLKNQLYLNLKRELNEIIKEYEENQKKILHSNQLVNDSLEQKTNRLVDIKPTKHGDIYTNKLSDNETEMLITSKEKKDETESTKRSGTDHTNSSESTTDDNTNDRNFSRSKNLSVAIYTAGSVALCVLIFSSIGLLLIKTNSGDNNSNEINEAFEPNDDVLFKEKDEIIEITFNDNDSTI

SEQ ID NO: 44 - protein, 3081 aa, Plasmodium falciparum
  misc_feature (1)..(3081): Protein of SEQ ID NO: 29
  ref <308>: DATABASE ACCESSION NUMBER: Genbank Accession No. AY138498
MKITLFCSISFCNIIFFFLELSHEHFVGQSSNTHGASSVTDFNFSEEKNLKSFEGKNNNNDNYASINRLYRKKPYMKRSLINLENDLFRLEPISYIQRYYKKNINRSDIFHNKKERGSKVYSNVSSFHSFIQEGKEEVEVFSIWGSNSVLDHIDVLRDNGTVVFSVQPYYLDIYTCKEAILFTTSFYKDLDKSSITKINEDIEKFNEEIIKNEEQCLVGGKTDFDNLLIVLENAEKANVRKTLFDNKFNDYKNKKSSFYNCLKNKKNDYDKKINNIKNEITKLLKNIESTGNMCKTESYVMNNNLYLLRVNEVKSTPIDLYLNRAKELLESSSKLVNPIKMKLGDNKNMYSIGYIHDEIKDIIKRYNFHLKHIEKGKEYIKRITQANNIADKMKKDELIKKIFESSKHFASFKYSNEMISKLDSLFIKNEQILNNLFNNIFNIFKKKYETYVDMKTIESKYTTVMTLSEHLLEYAMDVLKANPQKPIDPKANLDSEVVKLQIKINEKSNELDNAISQVNTLIIIMKSFYDIIISEKASMDEMEKKELSLNNYIEKTDYILQTYGIFKSKSNIINNNSKNISSKYIIIEGLKNDIDELNSLISYFKDSQETLIKDDELKKNMKTDYLNNVKYIEENVTHINEIILLKDSITQRIADIDELNSLNLININDFINEKNISQEKVSYNLNKLYKGSFEELESELSHFLDTKYLFHEKKSVNELQTILNTSNNECAKLNFMKSDNNNNNNNNSNIINLLKTELSHLLSLKENIIKKLLNHIEQNIQNSSNKYTITYTDINNRMEDYKEEIESLEVYKHTIGNIQKEYILHLYENDKNALAVHNTSMQILQYKDAIQNIKNKISDDIKILKKYKEMNQDLLNYYEILDKKLKDNTYIKEMHTASLVQITQYIPYEDKTISELEQEFNNNNQKLDNILQDINAMNLNINILQTLNIGINACNTNNKNVEHLLNKKIELKNILNDQMKIIKNDDIIQDNEKENFSNVLKKEEEKLEKELDDIKFNNLKMDIHKLLNSYDHTKQNIESNLKINLDSFEKEKDSWVHFKSTIDSLYVEYNICNQKTHNTIKQQKNDIIELIYKRIKDINQEIIEKVDNYYSLSDKALTKLKSIHFNIDKEKYKNPKSQENIKLLEDRVMILEKKIKEDKDALIQIKNLSHDHFVNADNEKKKQKEKEEDDEQTHYSKKRKVMGDIYKDIKKNLDELNNKNLIDITLNEANKIESEYEKILIDDICEQITNEAKKSDTIKEKIESYKKDIDYVDVDVSKTRNDHHLNGDKIHDSFFYEDTLNYKAYFDKLKDLYENINKLTNESNGLKSDAHNNNTQVDKLKEINLQVFSNLGNIIKYVEKLENTLHELKDMYEFLETIDINKILKSIHNSMKKSEEYSNETKKIFEQSVNITNQFIEDVEILKTSINPNYESLNDDQIDDNIKSLVLKKEEISEKRKQVNKYITDIESNKEQSDLHLRYTSRSIYVIDLFIKHEIINPSDGKNFDIIKVKEMINKTKQVSNEAMEYANKMDEKNKDIIKIENELYNLINNNIRSLKGVKYEKVRKQARNAIDDINNIHSNIKTILTKSKERLDEIKKQPNIKREGDVLNNDKTKIAYITIQINNGRIESNLLNILNMKHNIDTILNKAMDYMNDVSKSDQIVINIDSLNMNDIYNKDKDLLINILKEKQNMEAEYKKMNEMYNYVNETEKEIIKHKKNYEIRIMEHIKKETNEKKKKFMESNNKSLTTLMDSFRSMFYNEYINDYNINENFEKHQNILNEIYNGFNESYNIINTKMTEIINDNLDYNEIKEIKEVAQTEYDKLNKKVDELKNYLNNIKEQEGHRLIDYIKEKIFNLYIKCSEQQNIIDDSYNYITVKKQYIKTIEDVKFLLDSLNTIEEKNKSVANLEICTSKEDIKNLLKHVIKLANFSGIIVMSDTNTEITPENPLEDNDLLNLQLYFERKHEITSTLENDSDLELDHLGSNSDESIDNLKVYNDIIELHTYSTQILKYLDNIQKLKGDCNDLVKDCKELRELSTALYDLKIQITSVINRENDISNNIDIVSNKLNEIDAIQYNFEKYKEIFDNVEEYKTLDDTKNAYIVKKAEILKNVDINKTKEDLDIYFNDLDELEKSLTLSSNEMEIKTIVQNSYNSFSDINKNINDIDKEMKTLIPMLDELLNEGHNIDISLYNFIIRNIQIKIGNDIKNIREQENDTNICFEYIQNNYNFIKSDISIFNKYDDHIKVDNYISNNIDVVNKHNSLLSEHVINATNIIENIMTSIVEINEDTEMNSLEETQDKLLELYENFKKEKNIINNNYKIVHFNKLKEIENSLETYNSISTNFNKINETQNIDILKNEFNNIKTKINDKVKELVHVDSTLTLESIQTFNNLYGDLMSNIQDVYKYEDINNVELKKVKLYIENITNLLGRINTFIKELDKYQDENNGIDKYIEINKENNSYIIKLKEKANNLKENFSKLLQNIKRNETELYNINNIKDDIMNTGKSVNNIKQKFSSNLPLKEKLFQMEEMLLNINNIMNETKRISNTDAYTNITLQDIENNKNKENNNMNIETIDKLIDHIKIHNEKIQAEILIIDDAKRKVKEITDNINKAFNEITENYNNENNGVIKSAKNIVDEATYLNNELDKFLLKLNELLSHNNNDIKDLGDEKLILKEEEERKERERLEKAKQEEERKERERIEKEKQEKERLEREKQEQLQKEEELKRQEQERQEQQQKEEALKRQEQERLQKEEELKRQEQERLEREKQEQLQKEEELKRQEQERLQKEEALKRQEQERLQKEEELKRQEQERLERKKIELAEREQHIKSKLESDMVKIIKDELTKEKDEIIKNKDIKLRHSLEQKWLKHLQNILSLKIDSLLNKNDEVIKDNETQLKTNILNSLKNQLYLNLKRELNEIIKEYEENQKKILHSNQLVNDSLEQKTNRLVDIKPTKHGDIYTNKLSDNETEMLITSKEKKDETESTKRSGTDHTNSSESTTDDNTNDRNFSRSKNLSVAIYTAGSVALCVLIFSSIGLLLIKTNSGDNNSNEINEAFEPNDDVLFKEKDEIIEITFNDNDSTI

SEQ ID NO: 45 - protein, 3080 aa, Plasmodium falciparum
  misc_feature (1)..(3080): Protein of SEQ ID NO: 30
  ref <308>: DATABASE ACCESSION NUMBER: Genbank Accession No. AY138499
MKITLFCSISFCNIIFFFLELSHEHFVGQSSNTHGASSVTDFNFSEEKNLKSFEGKNNNNDNYASINRLYRKKPYMKRSLINLENDLFRLEPISYIQRYYKKNINRSDIFHNKKERGSKVYSNVSSFHSFIQEGKEEVEVFSIWGSNSVLDHIDVLRDNGTVVFSVQPYYLDIYTCKEAILFTTSFYKDLDKSSITKINEDIEKFNEEIIKNEEQCLVGGKTDFDNLLIVLENAEKANVRKTLFDNTFNDYKNKKSSFYNCLKNKKNDYDKKINNIKNEITKLLKNIEGTGKMCKTESYVMNNNLYLLRVNEVKSTPIDLYLNRAKELLESSSKLVNPIKMKLGDNKNMYSIGYIHDEIKDIIKRYNFHLKHIEKGKEYIKRITQANNIADKMKKDELIKKIFESSKHFASFKYSNEMISKLDSLFIKNEQILNNLFNNIFNIFKKKYETYVDMKTIESKYTTVMTLSEHLLEYAMDVLKANPQKPIDPKANLDSEVVKLQIKINEKSNELDNAISQVNTLIIIMKSFYDIIISEKASMDEMEKKELSLNNYIEKTDYILQTYGIFKSKSNIINNNSKNISSKYIIIEGLKNDIDELNSLISYFKDSQETLIKDDELKKNMKTDYLNNVKYIEENVTHINEIILLKDSITQRIADIDELNSLNLININDFINEKNISQEKVSYNLNKLYKGSFEELESELSHFLDTKYLFHEKKSVNELQTILNTSNNECAKLNFMKSDNNNNNNNNSNIINLLKTELSHLLSLKENIIKKLLNHIEQNIQNSSNKYTITYTDINNRMEDYKEEIESLEVYKHTIGNIQKEYILHLYENDKNALAVHNTSMQILQYKDAIQNIKNKISDDIKILKKYKEMNQDLLNYYEILDKKLKDNTYIKEMHTASLVQITQYIPYEDKTISELEQEFNNNNQKLDNILQDINAMNLNINILQTLNIGINACNTNNKNVEHLLNKKIELKNILNDQMKIIKNDDIIQDNEKENFSNVLKKEEEKLEKELDDIKFNNLKMDIHKLLNSYDHTKQNIESNLKINLDSFEKEKDSWVHFKSTIDSLYVEYNICNQKTHNTIKQQKNDIIELIYKRIKDINQEIIEKVDNYYSLSDKALTKLKSIHFNIDKEKYKNPKSQENIKLLEDRVMILEKKIKEDKDALIQIKNLSHDHFVNADNEKKKQKEKEEDDEQTHYSKKRKVMGDIYKDIKKNLDELNNKNLIDITLNEANKIESEYEKILIDDICEQITNEAKKSDTIKEKIESYKKDIDYVDVDVSKTRNDHHLNGDKIHDSFFYEDTLNYKAYFDKLKDLYENINKLTNESNGLKSDAHNNNTQVDKLKEINLQVFSNLGNIIKYVEKLENTLHELKDMYEFLETIDINKILKSIHNSMKKSEEYSNETKKIFEQSVNITNQFIEDVEILKTSINPNYESLNDDQIDDNIKSLVLKKEEISEKRKQVNKYITDIESNKEQSDLHLRYASRSIYVIDLFIKHEIINPSDGKNFDIIKVKEMINKTKQVSNEAMEYANKMDEKNKDIIKIENELYNLINNNIRSLKGVKYEKVRKQARNAIDDINNIHSNIKTILTKSKERLDEIKKQPNIKREGDVLNNDKNKIAYITIQINNGRIESNLLNILNMKHNIDTILNKAMDYMNDVSKSDQIVINIDSLNMNDIYNKDKDLLINILKEKQNMEAEYKKMNEMYNYVNETEKEIIKHKKNYEIRIMEHIKKETNEKKKKFMESNNKSLTTLMDSFRSMFYNEYINDYNINENFEKHQNILNEIYNGFNESYNIINTKMTEIINDNLDYNEIKEIKEVAQTEYDKLNKKVDELKNYLNNIKEQEGHRLIDYIKEKIFNLYIKCSEQQNIIDDSYNYITVKKQYIKTIEDVKFLLDSLNTIEEKNKSVANLEICTSKEDIKNLLKHVIKLANFSGIIVMSDTNTEITPENPLEDNDLLNLQLYFERKHEITSTLENDSDLELDHLGSNSDESIDNLKVYNDIIELHTYSTQILKYLDNIQKLKGDCNDLVKDCKELRELSTALYDLKIQITSVINRENDISNNIDIVSNKLNEIDAIQYNFEKYKEIFDNVEEYKTLDDTKNAYIVKKAEILKNVDINKTKEDLDIYFNDLDELEKSLTLSSNEMEIKTIVQNSYNSFSDINKNINDIDKEMKTLIPMLDELLNEGHNIDISLYNFIIRNIQIKIGNDIKNIREQENDTNICFEYIQNNYNFIKSDISIFNKYDDHIKVDNYISNNIDVVNKHNSLLSEHVINATNIIENIMTSIVEINEDTEMNSLEETQDKLLELYENFKKEKNIINNNYKIVHFNKLKEIENSLETYNSISTNFNKINETQNIDILKNEFNNIKTKINDKVKELVHVDSTLTLESIQTFNNLYGDLMSNIQDVYKYEDINNVELKKVKLYIENITNLLGRINTFIKELDKYQDENNGIDKYIEINKENNSYIIKLKEKANNLKENFSKLLQNIKRNETELYNINNIKDDIMNTGKSVNNIKQKFSSNLPLKEKLFQMEEMLLNINNIMNETKRISNTDVYTNITLQDIENNKNKENNNMNIETIDKLIDHIKIHNEKIQAEILIIDDAKRKVKEITDNINKAFNEITENYNNENNGVIKSAKNIVDEATYLNNELDKFLLKLNELLSHNNNDIKDLGDEKLILKEEEERKERERLEKAKQEEERKERERIEKEKQEKERLEREKQEQLKKEALKKQEQERQEQQQKEEALKRQEQERLQKEEELKRQEQERLEREKQEQLQKEEELKRQEQERLQKEEALKRQEQERLQKEEELKRQEQERLERKKIELAEREQHIKSKLESDMVKIIKDELTKEKDEIIKNKDIKLRHSLEQKWLKHLQNILSLKIDSLLNKNDEVIKDNETQLKTNILNSLKNQLYLNLKRELNEIIKEYEENQKKILHSNQLVNDSLEQKTNRLVDIKPTKHGDIYTNKLSDNETEMLITSKEKKDETESTKRSGTDHTNSSESTTDDNTNDRNFSRSKNLSVAIYTAGSVALCVLIFSSIGLLLIKTNSGDNNSNEINEAFEPNDDVLFKEKDEIIEITFNDNDSTI

SEQ ID NO: 46 - protein, 2770 aa, Plasmodium falciparum
  misc_feature (1)..(2770): Protein of SEQ ID NO: 31
  ref <308>: DATABASE ACCESSION NUMBER: Genbank Accession No. AF533700
MQRWIFCNIVLHILIYLAEFSHEQESYSSNEKIRKDYSDDNNYEPTPSYEKRKKEYGKDESYIKNYRGNNFSYDLSKNSSIFLHMGNGSNSKTLKRCNKKKNIKTNFLRPIEEEKTVLNNYVYKGVNFLDTIKRNDSSYKFDVYKDTSFLKNREYKELITMQYDYAYLEATKEVLYLIPKDKDYHKFYKNELEKILFNLKDSLKLLREGYIQSKLEMIRIHSDIDILNEFHQGNIINDNYFNNEIKKKKEDMEKYIREYNLYIYKYENQLKIKIQKLTNEVSINLNKSTCEKNCYNYILKLEKYKNIIKDKINKWKDLPEIYIDDKSFSYTFLKDVINNKIDIYKTISSFISTQKQLYYFEYIYIMNKNTLNLLSYNIQKTDINSSSKYTYTKSHFLKDNHILLSKYYTAKFIDILNKTYYYNLYKNKILLFNKYIIKLRNDLKEYAFKSIQFIQDKIKKHKDELSIENILQEVNNIYIKYDTSINEISKYNNLIINTDLQIVQQKLLEIKQKKNDITHKVQLINHIYKNIHDEILNKKNNEITKIIINNIKDHKKDLQDLLLFIQQIKQYNILTDHKITQCNNYYKEIIKMKEDINHIHIYIQPILNNLHTLKQVQNNKIKYEEHIKQILQKIYDKKESLKKIILLKDEAQLDITLLDDLIQKQTKKQTQTQTQTQKQTLIQNNETIQLISGQEDKHESNPFNHIQTYIQQKDTQNKNIQNLLKSLYNGNINTFIDTISKYILKQKDIELTQHVYTDEKINDYLEEIKNEQNKIDKTIDDIKIQETLKQITHIVNNIKTIKKDLLKEFIQHLIKYMNERYQNMQQGYNNLTNYINQYEEENNNMKQYITTIRNIQKIYYDNIYAKEKEIRSGQYYKDFITSRKNIYNIRENISKNVDMIKNEEKKKIQNCVDKYNSIKQYVKMLKNGDTQDENNNNNNDIYDKLIVPLDSIKQNIDKYNTEHNFITFTNKINTHNKKNQEMMEEFIYAYKRLKILKILNISLKACEKNNKSINTLNDKTQELKKIVTHEIDLLQKDILTSQISNKNVLLLNDLLKEIEQYIIDVHKLKKKSNDLFTYYEQSKNYFYFKNKKDNFDIQKTINKMNEWLAIKNYINEINKNYQTLYEKKINVLLHNSKSYVQYFYDHIINLILQKKNYLENTLKTKIQDNEHSLYALQQNEEYQKVKNEKDQNEIKKIKQLIEKNKNDILTYENNIEQIEQKNIELKTNAQNKDDQIVNTLNEVKKKIIYTYEKVDNQISNVLKNYEEGKVEYDKNVVQNVNDADDTNDIDEINDIDEINDIDEINDIDEINDIDEIKDIDHIKHFDDTKHFDDIYHADDTRDEYHIALSNYIKTELRNINLQEIKNNIIKIFKEFKSAHKEIKKESEQINKEFTKMDVVINQLRDIDRQMLDLYKELDEKYSEFNKTKIEEINNIRENINNVEIWYEKNIIEYFLRHMNDQKDKAAKYMENIDTYKNNIEIISKQINPENYVETLNKSNMYSYVEKANDLFYKQINNIIINSNQLKNEAFTIDELQNIQKNRKNLLTKKQQIIQYTNEIENIFNEIKNINNILVLTNYKSILQDISQNINHVSIYTEQLHNLYIKLEEEKEQMKTLYHKSNVLHNQINFNEDAFINNLLINIEKIKNDITHIKEKTNIYMIDVNKSKNNAQLYFHNTLRGNEKIEYLKNLKNSTNQQITLQELKQVQENVEKVKDIYNQTIKYEEKIKKNYHIITDYENKINDILHNSFIKQINMESSNNKKQTKQIIDIINDKTFEEHIKTSKTKINMLKEQSQMKHIDKTLLNEQALKLFVDINSTNNNLDNMLSEINSIQNNIHTYIQEANKSFDKFKIICDQNVNDLLNKLSLGDLNYMNHLKNLQNEIRNMNLEKNFMLDKSKKIDEEEKKLDILKVNISNINNSLDKLKKYYEEALFQKVKEKAEIQKENIEKIKQEINTLSDVFKKPFFFIQLNTDSSQHEKDINNNVETYKNNIDEIYNVFIQSYNLIQKYSSEIFSSTLNYIQTKEIKEKSIKEQNQLNQNEKEASVLLKNIKINETIKLFKQIKNERQNDVHNIKEDYNLLQQYLNYMKNEMEQLKKYKNDVHMDKNYVENNNGEKEKLLKETISSYYDKINNINNKLYIYKNKEDTYFNNMIKVSEILNIIIKKKQQNEQRIVINAEYDSSLINKDEEIKKEINNQIIELNKHNENISNIFKDIQNIKKQSQDIITNMNDMYKSTILLVDIIQKKEEALNKQKNILRNIDNILNKKENIIDKVIKCNCDDYKDILIQNETEYQKLQNINHTYEEKKKSIDILKIKNIKQKNIQEYKNKLEQMNTIINQSIEQHVFINADILQNEKIKLEEIIKNLDILDEQIMTYHNSIDELYKLGIQCDNHLITTISVVVNKNTTKIMIHIKKQKEDIQKINNYIQTNYNIINEEALQFHRLYGHNLISEDDKNNLVHIIKEQKNIYTQKEIDISKIIKHVKKGLYSLNEHDMNHDTHMNIINEHINNNILQPYTQLINMIKDIDNVFIKIQNNKFEQIQKYIEIIKSLEQLNKNINTDNLNKLKDTQNKLINIETEMKHKQKQLINKMNDIEKDNITDQYMHDVQQNIFEPITLKMNEYNTLLNDNHNNNINNEHQFNHLNSLHTKIFSHNYNKEQQQEYITNIMQRIDVFINDLDTYQYEYYFYEWNQEYKQIDKNKINQHINNIKNNLIHVKKQFEHTLENIKNNENIFDNIQLKKKDIDDIIININNTKETYLKELNKKKNVTK

SEQ ID NO: 47 - protein, 2976 aa, Plasmodium falciparum
  misc_feature (1)..(2976): Protein of SEQ ID NO: 32
  ref <308>: DATABASE ACCESSION NUMBER: Genbank Accession No. AF411933
MQRWIFCNIVLHILIYLAEFSHEQESYSSNEKIRKDYSDDNNYEPTPSYEKRKKEYGKDESYIKNYRGNNFSYDLSKNSSIFLHMGNGSNSKTLKRCNKKKNIKTNFLRPIEEEKTVLNNYVYKGVNFLDTIKRNDSSYKFDVYKDTSFLKNREYKELITMQYDYAYLEATKEVLYLIPKDKDYHKFYKNELEEILFNLKDSLKLLREGYIQSKLEMIRIHSDIDILNEFHQGNIINDNYFNNEIKKKKEDVEKYIREYNLYIYKYENQLKIKIQKLTNEVSINLNKSTCEKNCYNYILKLEKYKNIIKDKINKWKDLPEIYIDDKSFSYTFLKDVINNKIDIYKTISSFISTQKQLYYLEYIYIMNKNTLNLLSYNIQKTDINSSSKYTYTKSHFLKDNHILLSKYYTAKFIDILNKTYYYNLYKNKILLFNKYIINLRNDLKEYAFKSIQFIQDKIKKHKDELSIENILQEVNNIYIKYDTSINEISKYNNLIINTDLQIVQQKLLEIKQKKNDITHKVQLINHIYKNIHDEILNKKNNEITKIIINNIKDHKKDLQDLLLFIQQIKQYNILTDHNITQCNNYYKEIIKMKEDINHIHIYIQPILNNLHTLKQVQNNKIKYEEHIKQILQKIYDKKESLKKIILLKDEAQLDITLLDDLIQKQTKKQTQTQTQTQKQTLIQNNETIQLISGQEDKHESNPFNHIQTYIQQKDTQNKNIQNLLKSLYNGNINTFIDTISKYILKQKDIELTQHVYTDEKINDYLEEIKNEQNKIDKTIDDIKIQETLKQITHIVNNIKTIKKDLLKEFIQHLIKYMNERYQNMQQGYNNLTNYINQYEEENNNMKQYITTIRNIQKIYYDNIYAKEKEIRSGQYYKDFITSRKNIYNIRENISKNVDMIKNEEKKKIQNCVDKYNSIKQCVKMLKNGDTQDENNNNNNNNNNNDIYDKLIVPLDSIKQNIDKYNTEHNFITFTNKINTHNKKNQEMMEEFIYAYKRLKILKILNISLKACEKNNKSINTLNDKTQELKKIVTHEIDLLQKDILTSQISNKNVLLLNDLLKEIEQYIIDVHKLKKKSNDLFTYYEQSKNYFYFKNKKDNFDIQKTINKMNEWLAIKNYINEINKNYQTLYEKKINVLLHNSKSYVQYFYDHIINLILQKKNYLENTLKTKIQDNEHSLYALQQNEEYQKVKNEKDQNEIKKIKQLIEKNKNDILTYENNIEQIEQKNIELKTNAQNKDDQIVNTLNEVKKKIIYTYEKVDNQISNVLKNYEEGKVEYDKNVVQNVNDADDTNDIDEINDIDEINDIDEINDIDEIKDIDHIKHFDDTKHFDDIYHADDTRDEYHIALSNYIKTELRNINLQEIKNNIIKIFKEFKSAHKEIKKESKQINKEFTKMDVVINQLRDIDRQMLDLYKELDEKYSEFNKTKIEEINNIRENINNVEIWYEKNIIEYFLRHMNDQKDKAAKYMENIDTYKNNIEIISKQINPENYVETLNKSNMYSYVEKANDLFYKQINNIIINSNQLKNEAFTIDELQNIQKNRKNLLTKKQQIIQYTNEIENIFNEIKNINNILVLTNYKSILQDISQNINHVSIYTEQLHNLYIKLEEEKEQMKTLYHKSNVLHNQINFNEDAFINNLLINIEKIKNDITHIKEKTNIYMIDVNKSKNNAQLYFHNTLRGNEKIEYLKNLKNSTNQQITLQELKQVQENVEKVKDIYNQTIKYEEKIKKNYHIITDYENKINDILHNSFIKQINMESSNNKKQTKQIIDIINDKTFEEHIKTSKTKINMLKEQSQMKHIDKTLLNEQALKLFVDINSTNNNLDNMLSEINSIQNNIHTYIQEANKSFDKFKIICDQNVNDLLNKLSLGDLNYMNHLKNLQNEIRNMNLEKNFMLDKSKKIDEEEKKLDILKVNISNINNSLDKLKKYYEEALFQKVKEKAENQKENIEKIKQEINTLSDVFKKPFFFIQLNTDSSQHEKDINNNVETYKNNIDEIYNVFIQSYNLIQKYSSEIFSSTLNYIQTKEIKEKSIKEQNQLNQNEKEASVLLKNIKINETIKLFKQIKNERQNDVHNIKEDYNLLQQYLNYMKNEMEQLKKYKNDVHMDKNYVENNNGEKEKLLKETISSYYDKINNINNKLYIYKNKEDTYFNNMIKVSEILNIIIKKKQQNEQRIVINAEYDSSLINKDEEIKKEINNQIIELNKHNENISNIFKDIQNIKKQSQDIITNMNDMHKSTILLVDIIQKKEEALNKQKNILRNIDNILNKKENIIDKVIKCNCDDYKDILIQNETEYQKLQNINHTYEEKKKSIDILKIKNIKQKNIQEYKNKLEQMNTIINQSIEQHVFINADILQNEKIKLEEIIKNLDILDEQIMTYHNSIDELYKLGIQCDNHLITTISVVVNKNTTKIMIHIKKQKEDIQKINNYIQTNYNIINEEALQFHRLYGHNLISEDDKNNLVHIIKEQKNIYTQKEIDISKIIKHVKKGLYSLNEHDMNHDTHMNIINEHINNNILQPYTQLINMIKDIDNVFIKIQNNKFEQIQKYIEIIKSLEQLNKNINTDNLNKLKDTQNKLINIETEMKHKQKQLINKMNDIEKDNITDQYMHDVQQNIFEPITLKMNEYNTLLNDNHNNNINNEHQFNHLNSLHTKIFSHNYNKEQQQEYITNIMQRIDVFINDLDTYQYEYYFYEWNQEYKQIDKNKINQHINNIKNNLIHVKKQFEHTLENIKNNENIFDNIQLKKKDIDDIIININNTKETYLKELNKKKMLQNKKKVDEKSEINNHHTLQHDNQNVEQKNKIKDHNLITKPNNNSSEESHQNEQMKEQNKNILEKQTRNIKPHHVHNHNHNHNHNHNQNQNQKDSTKLQEQDISTHKLHNTIHEQQSKDNHQGNREKKQKNGNHERMYFASGIVVSILFLSSLGFVINSKNNKQEYDKEQEKQQQNDFVCDNNKMDDKSTQKYGRNQEEVMEISFDNDYI

SEQ ID NO: 48 - protein, 2969 aa, Plasmodium falciparum
  misc_feature (1)..(2969): Protein of SEQ ID NO: 33
  ref <308>: DATABASE ACCESSION NUMBER: Genbank Accession No. AF411930
MQRWIFCNIVLHILIYLAEFSHEQESYSSNEKIRKDYSDDNNYEPTPSYEKRKKEYGKDESYIKNYRGNNFSYDLSKNSSIFLHMGNGSNSKTLKRCNKKKNIKTNFLRPIEEEKTVLNNYVYKGVNFLDTIKRNDSSYKFDVYKDTSFLKNREYKELITMQYDYAYLEATKEVLYLIPKDKDYHKFYKNKLEKILFNLKDSLKLLREGYIQSKLEMIRIHSDIDILNEFHQGNIINDNYFNNEIKKKKEDMEKYIREYNLYIYKYENQLKIKIQKLTNEVSINLNKSTCEKNCYNYILKLEKYKNIIKDKINKWKDLPEIYIDDKSFSYTFLKDVINNKIDIYKTISSFISTQKQLYYLEYIYIMNKNTLNLLSYNIQKTDINSSSKYTYTKSHFLKDNHILLSKYYTAKFIDILNKTYYYNLYKNKILLFNKYIIKLRNDLKEYAFKSIQFIQDKIKKHKDELSIENILQEVNNIYIKYDTSINEISKYNNLIINTDLQIVQQKLLEIKQKKNDITHKVQLINHIYKNIHDEILNKKNNEITKIIINNIKDHKKDLQDLLLFIQQIKQYNILTDHNITQCNNYYKEIIKMKEDINHIHIYIQPILNNLHTLKQVQNNKIKYEEHIKQILQKIYDKKESLKKIILLKDEAQLDITLLDDLIQKQTKKQTQKQTQTQKQTLIQNNETIQLISGQEDKHESNPFNHIQTYIQQKDTQNKNIQNLLKSLYNGNINTFIDTISKYILKQKDIELTQHVYTDEKINDYLEEIKNEQNKIDKTIDDIKIQETLKQITHIVNNIKTIKKDLLKEFIQHLIKYMNERYQNMQQGYNNLTNYINQYEEENNNMKQYITTIRNIQKIYYDNIYAKEKEIRSGQYYKDFITSRKNIYNIRENISKNVDMIKNEEKKKIQNCVDKYNSIKQYVKMFKNGDTQDENNNNNNDIYDKLIVPLDSIKQNIDKYNTEHNFITFTNKINTHNKKNQEMMEEFIYAYKRLKILKILNISLKACEKNNKSINTLNDKTQELKKIVTHEIDLLQKDILTSQISNKNVLLLNDLLKEIEQYIIDVHKLKKKSNDLFTYYEQSKNYFYFKNKKDNFDIQKTINKMNEWLAIKNYINEINKNYQTLYEKKINVLLHNSKSYVQYFYDHIINLILQKKNYLENTLKTKIQDNEHSLYALQQNEEYQKVKNEKDQNEIKKIKQLIEKNKNDILTYENNIEQIEQKNIELKTNAQNKDDQIVNTLNEVKKKIIYTYEKVDNQISNVLKNYEEGKVEYDKNVVQNVNDADDTNDIDEINDIDEINDIDEIKDIDHIKHFDDTKHFDDIYHADDTRDEYHIALSNYIKTELRNINLQEIKNNIIKIFKEFKSAHKEIKKESEQINKEFTKMDVVINQLRDIDRQMLDLYKELDEKYSEFNKTKIEEINNIRENINNVEIWYEKNIIEYFLRHMNDQKDKAAKYMENIDTYKNNIEIISKQINPENYVETLNKSNMYSYVEKANDLFYKQINNIIINSNQLKNEAFTIDELQNIQKNRKNLLTKKQQIIQYTNEIENIFNEIKNINNILVLTNYKSILQDISQNINHVSIYTEQLHNLYIKLEEEKEQMKTLYHKSNVLHNQINFNEDAFINNLLINIEKIKNDITHIKEKTNIYMIDVNKSKNNAQLYFHNTLRGNEKIEYLKNLKNSTNQQITLQELKQVQENVEKVKDIYNQTIKYEEEIKKNYHIITDYENKINDILHNSFIKQINMESSNNKKQTKQIIDIINDKTFEEHIKTSKTKINMLKEQSQMKHIDKTLLNEQALKLFVDINSTNNNLDNMLSEINSIQNNIHTYIQEANKSFDKFKIICDQNVNDLLNKLSLGDLNYMNHLKNLQNEIRNMNLEKNFMLDKSKKIDEEEKKLDILKVNISNINNSLDKLKKYYEEALFQKVKEKAEIQKENIEKIKQEINTLSDVFKKPFFFIQLNTDSSQHEKDINNNVETYKNNIDEIYNVFIQSYNLIQKYSSEIFSSTLNYIQTKEIKEKSIKEQNQLNQNEKEASVLLKNIKINETIKLFKQIKNERQNDVHNIKEDYNLLQQYLNYMKNEMEQLKKYKIDVHMDKNYVENNNGEKEKLLKETISSYYDKINNINNKLYIYKNKEDTYFNNMIKVSEILNIIIKKKQQNEQRIVINAEYDSSLINKDEEIKKEINNQIIELNKHNENISNIFKDIQNIKKQSQDIITNMNDMCKSTILLVDIIQKKEEALNKQKNILRNIDNILNKKENIIDKVIKCNCDDYKDILIQNETEYQKLQNINHTYEEKKKSIDILKIKNIKQKNIQEYKNKLEQMNTIINQSIEQHVFINADILQNEKIKLEEIIKNLDILDEQIMTYHNSIDELYKLGIQCDNHLITTISVVVNKNTTKIMIHIKKQKEDIQKINNYIQTNYNIINEEALQFHRLYGHNLISEDDKNNLVHIIKEQKNIYTQKEIDISKIIKHVKKGLYSLNEHDMNHDTHMNIINEHINNNILQPYTQLINMIKDIDNVFIKIQNNKFEQIQKYIEIIKSLEQLNKNINTDNLNKLKDTQNKLINIETEMKHKQKQLINKMNDIEKDNITDQYMHDVQQNIFEPITLKMNEYNTLLNDDHNNNINNEHQFNHLNSLHTKIFSHNYNKEQQQEYITNIMQRIDVFINDLDTYQYEYYFYEWNQEYKQIDKNKINQHINNIKNNLIHVKKQFEHTLENIKNNENIFDNIQLKKKDIDDIIININNTKETYLKELNKKKMLQNKKKVDEKSEINNHHTLQHDNQNVEQKNKIKDHNLITKPNNNSSEESHQNEQMKEQNKNILEKQTRNIKPHHVHNHNHNHNHNHNHNHNHNQNQKDSTKLQEQDISTHKLHNTIHEQQSKDNHQGNREKKQKNGNHERMYFASGIVVSILFLSSLGFVINSKNNKQEYDKEQEKQQQNDFVCDNNKMDDKSTQKYGRNQEEVMEISFDNDYI

SEQ ID NO: 49 - protein, 2957 aa, Plasmodium falciparum
  misc_feature (1)..(2957): Protein of SEQ ID NO: 34
  ref <308>: DATABASE ACCESSION NUMBER: Genbank Accession No. AF411931
MQRWIFCNIVLHILIYLAEFSHEQESYSSNEKIRKDYSDDNNYEPTPSYEKRKKEYGKDESYIKNYRGNNFSYDLSKNSSIFLHMGNGSNSKTLKRCNKKKNIKTNFLRPIEEEKTVLNNYVYKGVNFLDTIKRNDSSYKFDVYKDTSFLKNREYKELITMQYDYAYLEATKEVLYLIPKDKDYHKFYKNELEKILFNLKDSLKLLREGYIQSKLEMIRIHSDIDILNEFHQGNIINDNYFNNEIKKKKEDVEKYIREYNLYIYKYENQLKIEIQKLTNEVSINLNKSTCEKNCYYYILKLEKYKNIIKDKINKWTDLPEIYIDDKSFSYTFLKDVINNKIDIYKTISSFISTQKQLYYFEYIYIMNKNTLNLLSYNIQKTDINSSSKYTYTKSHFLKDNHILLSKYYTAKFIDILNKTYYYNLYKNKILLFNKYIIKLRNDLKEYAFKSIQFIQDKIKKHKDELSIENILQEVNNIYIKYDTSINEISKYNNLIINTDLQIVQQKLLEIKQKKNDITHKVQLINHIYKNIHDEILNKKNNEITKIIINNIKDHKKDLQDLLLFIQQIKQYNILTDHNITQCNNYYKEIIKMKEDINHIHIYIQPILNNLHTLKQVQNNKIKYEEHIKQILQKIYDKKESLKKIILLKDEAQLDITLLDDLIQKQTQTQKQTLIQNNETIQLISGQEDKHESNPFNHIQTYIQQKDTQNKNIQNLLKSLYNGNINTFIDTISKYILKQKDIELTQHVYTDEKINDYLEEIKNEQNKIDKTIDDIKIQETLKQITHIVNNIKTIKKDLLKEFIQHLIKYMNERYQNMQQGYNNLTNYINQYEEENNNMKQYITTIRNIQKIYYDNIYAKEKEIRSGQYYKDFITSRKNIYNIRENISKNVDMIKNEEKKKIQNCVDKYNSIKQYVKMFKNGDTQDENNNNNNDIYDKLIVPLDSIKQNIDKYNTEHNFITFTNKINTHNKKNQEMMEEFIYVYKRLKILKILNISLKACEKNNKSINTLNDKTQELKKIVTHEIDLLQKDILTSQISNKNVLLLNDLLKEIEQYIIDIHKLKKKSNDLFTYYEQSKNYFYFKNKKDNFDIQKTINKMNEWLAIKNYINEINKNYQTLYEKKINVLLHNSKSYVQYFYDHIINLILQKKNYLENTLKTKIQDNEHSLYALQQNEEYQKVKNEKDQNEIKKIKQLIEKNKNDILTYENNIEQIEQKNIELKTNAQNKDDQIVNTLNEVKKKIIYTYEKVDNQISNVLKNYEEGKVEYDKNVVQNVNDADDTNDIDEINDIDEINDIDEINDIDEIKDIDHIKHFDDTKHFDDIYHADDTRDEYHIALSNYIKTELRNINLQEIKNNIIKIFKEFESAHKEIKKESKQINKEFTKMDVVINQLRDIDRQMLDLYKELDEKYSEFNKTKIEEINNIRENINNVEIWYEKNIIEYFLRYMNDQKDKAAKYMENIDTYKNNIEIISKQINPENYVETLKKTNMYSYVEKANDLFYKQINNIIINSNQLKNEAFTIDELQNIQKNRKNLLTKKQQIIQYTNEIENIFNEIKNINNILVLTNYKSILQDISQNINHVSIYTEQLHNLYIKLEEEKEQMKTLYHKSNVLHNQINFNEDAFINNLLINIEKIKNDITHIKEKTNIYMIDVNKSKNNAQLYFHNTLRGNEKIEYLKNLKNSTNQQITLQELKQVQENVEKVKDIYNQTIKYEEKIKKNYHIITDYENKINDILHNSFIKQINMESSNNKKQTKQIIDIINDKTFEEHIKTSKTKINMLKEQSQMKHIDKTLLNEQALKLFVDINSTNNNLDNMLSEINSIQNNIHTYIQEANKSFDKFKIICDQNVNDLLNKLSLGDLNYMNHLKNLQNEIRNMNLEKNFMLDKSKKIDEEEKKLDILKVNISNINNSLDKLKKYYEEALFQKVKEKAEIQKENIEKIKQEINTLSDVFKKPFFFIQLNTDSSQHEKDINNNVETYKNNIDEIYNVFIQSYNLIQKYSSEIFSSTLNYIQTKEIKEKSIKEQNQLNQNEKEASVLLKNIKINETIKLFKQIKNERQNDVHNIKEDYNLLQQYLNYMKNEMEQLKKYKNDVHMDKNYVENNNGEKEKLLKETISSYYDKINNINNKLYIYKNKEDTYFNNMIKVSEILNIIIKKKQQNEQRIVINAEYDSSLINKDEEIKKEINNQIIELNKHNENISIIFKDIQNIKKQSQDIITNMNDMHKSTILLVDIIQKKEEALNKQKNILRNIDNILNKKENIIDKVIKCNCDDYKDILIQNETEYQKLQNINHTYEEKKKSIDILKIKNIKQKNIQEYKNKLEQMNTIINQSIEQHVFINADILQNEKIKLEEIIKNLDILDEQIMTYHNSIDELYKLGIQCDNHLITTISVVVNKNTTKIMIHIKKQKEDIQKINNYIQTNYNIINEEALQFHRLYGHNLISEDDKNNLVHIIKEQKNIYTQKEIDISKIIKHVKKGLYSLNEHDMNHDTHMNIINEHINNNILQPYTQLINMIKDIDNVFIKIQNNKFEQIQKYIEIIKSLEQLNKNINTDNLNKLKDTQNKLINIETEMKHKQKQLINKMNDIEKDNITDQYMHDVQQNIFEPITLKMNEYNTLLNDNHNNNINNEHQFNHLNSLHTKIFSHNYNKEQQQEYITNIMQRIDVFINDLDTYQYEYYFYEWNQEYKQIDKNKINQHINNIKNNLIHVKKQFEHTLENIKNNENIFDNIQLKKKDIDDIIININNTKETYLKELNKKKMLQNKKKVDEKSEINNHHTLQHDNQNVEQKNKIKDHNLITKPNNNSSEESHQNEQMKEQNKNILEKQTRNIKPHHVHNHNHNHNQNQKDSTKLQEQDISTHKLHNTIHEQQSKDNHQGNREKKQKNGNHERMYFASGIVVSILFLSSLGFVINSKNNKQEYDKEQEKQQQNDFVCDNNKMDDKSTQKYGRNQEEVMEISFDNDYI

SEQ ID NO: 50 - protein, 2977 aa, Plasmodium falciparum
  misc_feature (1)..(2977): Protein of SEQ ID NO: 35
  ref <308>: DATABASE ACCESSION NUMBER: Genbank Accession No. AF411929
MQRWIFCNIVLHILIYLAEFSHEQESYSSNEKIRKDYSDDNNYEPTPSYEKRKKEYGKDESYIKNYRGNNFSYDLSKNSSIFLHMGNGSNSKTLKRCNKKKNIKTNFLRPIEEEKTVLNNYVYKGVNFLDTIKRNDSSYKFDVYKDTSFLKNREYKELITMQYDYAYLEATKEVLYLIPKDKDYHKFYKNKLEKILFNLKDSLKLLREGYIQSKLEMIRIHSDIDILNEFHQGNIINDNYFNNEIKKKKEDMEKYIREYNLYIYKYENQLKIEIQKLTNEVSINLNKSTCEKNCYYYILKLEKYKNIIKDKINKWKDLPEIYIDDKSFSYTFLKDVINNKIDIYKTISSFISTQKQLYYLEYIYIMNKNTLNLLSYNIQKTDINSSSKYTYTKSHFLKDNHILLSKYYTAKFIDILNKTYYYNLYKNKILLFNKYIIKLRNDLKEYAFKSIQFIQDKIKKHKDELSIENILQEVNNIYIKYDTSINEISKYNNLIINTDLQIVQQKLLEIKQKKNDITHKVQLINHIYKNIHDEILNKKNNEITKIIINNIKDHKKDLQDLLLFIQQIKQYNILTDHNITQCNNYYKEIIKMKEDINHIHIYIQPILNNLHTLKQVQNNKIKYEEHIKQILQKIYDKKESLKKIILLKDEAQLDITLLDDLIQKQTQTQTQTQKQTLIQNNETIQLISGQEDKHESNPFNHIQTYIQQKDTQNKNIQNLLKSLYNGNINTFIDTISKYILKQKDIELTQHVYTDEKINDYLEEIKNEQNKIDKTIDDIKIQETLKQITHIVNNIKTIKKDLLKEFIQHLIKYMNERYQNMQQGYNNLTNYINQYEEENNNMKQYITTIRNIQKIYYDNIYAKEKEIRSGQYYKDFITSRKNIYNIRENISKNVDMIKNEEKKKIQNCVDKYNSIKQYVKMFKNGDTQDENNNNNNDIYDKLIVPLDSIKQNIDKYNTEHNFITFTNKINTHNKKNQEMMEEFIYVYKRLKILKILNISLKACEKNNKSINTLNDKTQELKKIVTHEIDLLQKDILTSQISNKNVLLLNDLLKEIEQYIIDVHKLKKKSNDLFTYYEQSKNYFYFKNKKDNFDIQKTINKMNEWLAIKNYINEINKNYQTLYEKKINVLLHNSKSYVQYFYDHIINLILQKKNYLENTLKTKIQDNEHSLYALQQNEEYQKVKNEKDQNEIKKIKQLIEKNKNDILTYENNIEQIEQKNIELKTNAQNKDDQIVNTLNEVKKKIIYTYEKVDNQISNVLKNYEEGKVEYDKNVVQNVNDADDTNDIDEINDIDEINDIDEINDIDEINDIDEIKDIDHIKHFDDTKHFDDIYHADDTRDEYHIALSNYIKTELRNINLQEIKNNIIKIFKEFESAHKEIKKESKQINKEFTKMDVVINQLRDIDRQMLDLYKELDEKYSEFNKTKIEEINNIRENINNVEIWYEKNIIEYFLRHMNDQKDKAAKYMENIDTYKNNIEIISKQINPENYVETLNKSNMYSYVEKANDLFYKQINNIIINSNQLKNEAFTIDELQNIQKNRKNLLTKKQQIIQYTNEIENIFNEIKNINNILVLTNYKSILQDISQNINHVSIYTEQLHNLYIKLEEEKEQMKTLYHKSNVLHNQINFNEDAFINNLLINIEKIKNDITHIKEKTNIYMIDVNKSKNNAQLYFHNTLRGNEKIEYLKNLKNSTNQQITLQELKQVQENVEKVKDIYNQTIKYEEKIKKNYHIITDYENKINDILHNSFIKQINMESSNNKKQTKQIIDIINDKTFEEHIKTSKTKINMLKEQSQMKHIDKTLLNEQALKLFVDINSTNNNLDNMLSEINSIQNNIHTYIQEANKSFDKFKIICDQNVNDLLNKLSLGDLNYMNHLKNLQNEIRNMNLEKNFMLDKSKKIDEEEKKLDILKVNISNINNSLDKLKKYYEEALFQKVKEKAENQKENIEKIKQEINTLSDVFKKPFFFIQLNTDSSQHEKDINNNVETYKNNIDEIYNVFIQSYNLIQKYSSEIFSSTLNYIQTKEIKEKSIKEQNQLNQNEKEAFVLLKNIKINETIKLFKQIKNERQNDVHNIKEDYNLLQQYLNYMKNEMEQLKKYKNDVHMDKNYVENNNGEKEKLLKETISSYYDKINNINNKLYIYKNKEDTYFNNMIKVSEILNIIIKKKQQNEQRIVINAEYDSSLINKDEEIKKEINNQIIELNKHNENISNIFKDIQNIKKQSQDIITNMNDMHKSTILLVDIIQKKEEALNKQKNILRNIDNILNKKENIIDKVIKCNCDDYKDILIQNETEYQKLQNINHTYEEKKKSIDILKIKNIKQKNIQEYKNKLEQMNTIINQSIEQHVFINADILQNEKIKLEEIIKNLDILDEQIMTYHNSIDELYKLGIQCDNHLITTISVVVNKNTTKIMIHIKKQKEDIQKINNYIQTNYNIINEEALQFHRLYGHNLISEDDKNNLVHIIKEQKNIYTQKEIDISKIIKHVKKGLYSLNEHDMNHDTHMNIINEHINNNILQPYTQLINMIKDIDNVFIKIQNNKFEQIQKYIEIIKSLEQLNKNINTDNLNKLKDTQNKLINIETEMKHKQKQLINKMNDIEKDNITDQYMHDVQQNIFEPITLKMNEYNTLLNDDHNNNINNEHQFNHLNSLHTKIFSHNYNKEQQQEYITNIMQRIDVFINDLDTYQYEYYFYEWNQEYKQIDKNKINQHINNIKNNLIHVKKQFEHTLENIKNNENIFDNIQLKKKDIDDIIININNTKETYLKELNKKKMLQNKKKVDEKSEINNHHTLQHDNQNVEQKNKIKDHNLITKPNNNSSEESHQNEQMKEQNKNILEKQTRNIKPHHVHNHNHNHNHNHNHNHNHNQNQKDSTKLQEQDISTHKLHNTIHEQQSKDNHQGNREKKQKNGNHERMYFASGIVVSILFLSSLGFVINSKNNKQEYDKEQEKQQQNDFVCDNNKMDDKSTQKYGRNQEEVMEISFDNDYI

SEQ ID NO: 51 - protein, 1716 aa, Plasmodium falciparum; identical to SEQ ID NO: 3
  misc_feature (1)..(1716): Protein of SEQ ID NO: 36
  ref <308>: DATABASE ACCESSION NUMBER: Genbank Accession No. AF432854

SEQ ID NO: 52 - protein, 1711 aa, Plasmodium falciparum
  misc_feature (1)..(1711): Protein of SEQ ID NO: 37
  ref <308>: DATABASE ACCESSION NUMBER: Genbank Accession No. AF420309
MNKNILWITFFHFLFFLLDMYQGNDAIPSKEKKNDPEADSKNSQNQHDINKTHHTNNNYDLNIKDKDEKKRKNDNLINNYDYSLLKLSYNKNQDIYKNIQNGQKLKTDIILNSFVQINSSNILMDEIENYVKKYTESNRIMYLQFKYIYLQSLNITVSFVPPNSPFRSYYDKNLNKDINETCHSIQTLLNNLISSKIIFKMLETTKEQILLLWNNKKISQQNYNQENQEKSKMIDSENEKLEKYTNKFEHNIKPHIEDIEKKVNEYINNSDCHLTCSKYKTIINNYIDEIITTNTNIYENKYNLPQERIIKNYNHNGINNDDNFIEYNILNADPDLRSHFITLLVSRKQLIYIEYIYFINKHIVNKIQENFKLNQNKYIHFINSNNAVNAAKEYEYIIKYYTTFKYLQTLNKSLYDSIYKHKINNYSHNIEDLINQLQHKINNLMIISFDKNKSSDLMLQCTNIKKYTDDICLSIKPKALEVEYLRNINKHINKNEFLNKFMQNETFKKNIDDKIKEMNNIYDNIYIILKQKFLNKLNEIIQNHKNKQETKLNTTTIQELLQLLKDIKEIQTKQIDTKINTFNMYYNDIQQIKIKINQNEKEIKKVLPQLYIPKNEQEYIQIYKNELKDRIKETQTKINLFKQILELKEKEHYITNKHTYLNFTHKTIQQILQQQYKNNTQEKNTLAQFLYNADIKKYIDELIPITQQIQTKMYTTNNIEHIKQILINYIQECKPIQNISEHTIYTLYQEIKTNLENIEQKIMQNIQQTTNRLKINIKKIFDQINQKYDDLTKNINQMNDEKIGLRQMENRLKGKYEEIKKANLQDRDIKYIVQNNDANINNNNNNNIIIINGNNQTGDYNHILFDYTHLWDNAQFTRTKENINNLKDNIQININNIKSIIRNLQNELNNYNTLKSNSIHIYDKIHTLEELKILTQEINDKNVIRKIYDIETIYQNDLHNIEEIIKNITSIYYKINILNILIICIKQTYNNNKSIESLKLKINNLTNSTQEYINQIKAIPTNLLPEHIKQKSVSELNIYMKQIYDKLNEHVINNLYTKSKDSLQFYINEKNYNNNHDDHNDVYNDIKENEIYKNNKLYECIQIKKDVDELYNIYDQLFKNISQNYNNHSLSFVHSINNHMLSIFQDTKYGKHKNQQILSDIENIIKQNEHTESYKNLDTSNIQLIKEQIKYFLQIFHILQENITTFENQYKDLIIKMNHKINNNLKDITHIVINDNNTLQEQNRIYNELQNKIKQIKNVSDVFTHNINYSQQILNYSQAQNSFFNIFMKFQNINNDINSKRYNVQKKITEIINSYDIINYNKNNIKDIYQQFKNIQQQLNTTETQLNHIKQNINHFKYFYESHQTISIVKNMQNEKLKIQEFNKKIQHFKEETQIMINKLIQPSHIHLHKMKLPITQQQLNTILHRNEQTKNATRSYNMNEEENEMGYGITNKRKNSETNDMINTTIGDKTNVLKNDDQERGKRGTSRNNNIHTNENNINNEHTNENNINNEHTNEKNINNEHANEKNIYNEHTNENNINYEHPNNYQQKNDEKISLQHKTINTSQRTIDDSNMDRNNRYNTSSQQKNNLHTNNNSNSRYNNNHDKQNEHKYNQGKSSGKDNAYYRIFYAGGITAVLLLCSSTAFFFIKNSNEPHHIFNIFQKEFSEADNAHSEEKEEYLPVYFDEVEDEVEDEDENENEVENENEDFNDI

The invention claimed is:

1. A composition comprising:
   (a) at least one immunogenic erythrocyte binding antigen (EBA) molecule of an EBA protein of a strain of *Plasmodium falciparum*, the EBA molecule consisting of an amino acid sequence selected from the group consisting of:
      (i) the amino acid sequence of residue 746 to residue 1045 of SEQ ID NO: 9,
      (ii) the amino acid sequence of residue 761 to residue 1271 of SEQ ID NO: 5, and
      (iii) the amino acid sequence of residue 755 to residue 1339 of SEQ ID NO: 7, and
   (b) at least one immunogenic reticulocyte-binding protein homologue (Rh) molecule comprising a contiguous amino acid sequence of a Rh protein of a strain of *Plasmodium falciparum* selected from the group consisting of SEQ ID NO: 1, SEQ ID NO: 3, SEQ ID NO: 13, SEQ ID NO: 38, SEQ ID NO: 39, SEQ ID NO: 40, SEQ ID NO: 41, SEQ ID NO: 46, SEQ ID NO:47, SEQ ID NO:48, SEQ ID NO: 49, SEQ ID NO: 50, SEQ ID NO: 51 and SEQ ID NO: 52, wherein when administered to a subject the composition induces an invasion-inhibitory immune response to the strain,
   wherein said composition is substantially free from other proteins of *Plasmodium*.

2. The composition according to claim 1 wherein one or more of the strains is a wild type strain.

3. A pharmaceutical composition comprising the immunogenic molecules according to claim 1 and a pharmaceutically acceptable excipient.

4. The composition according to claim 3 wherein the pharmaceutically acceptable excipient comprises a vaccine adjuvant.

5. The composition according to claim 3, wherein the immunogenic Rh molecule has an amino acid sequence selected from the group consisting of SEQ ID NO: 46, SEQ ID NO:47, SEQ ID NO:48, SEQ ID NO: 49 and SEQ ID NO: 50.

6. The composition according to claim 3, wherein the immunogenic Rh molecule has an amino acid sequence selected from the group consisting of SEQ ID NO: 38, SEQ ID NO: 39, SEQ ID NO: 40, and SEQ ID NO: 41.

7. The composition according to claim 3, wherein the immunogenic Rh molecule comprises at least one contiguous amino acid sequence selected from the group consisting of:
 (i) the amino acid sequence of residue 2184 to residue 3113 of SEQ ID NO: 1,
 (ii) the amino acid sequence of residue 2027 to residue 3115 of SEQ ID NO: 1,
 (iii) the amino acid sequence of residue 2027 to residue 2533 of SEQ ID NO: 1,
 (iv) the amino acid sequence of residue 2098 to residue 2597 of SEQ ID NO: 1,
 (v) the amino acid sequence of residue 2616 to residue 3115 of SEQ ID NO: 1,
 (vi) the amino acid sequence of residue 1288 to residue 1856 of SEQ ID NO: 1,
 (vii) the amino acid sequence of residue 297 to residue 726 of SEQ ID NO: 1,
 (viii) the amino acid sequence of residue 34 to residue 322 of SEQ ID NO: 1,
 (ix) the amino acid sequence of residue 673 to residue 1288 of SEQ ID NO: 1,
 (x) the amino acid sequence of residue 2030 to residue 2528 of SEQ ID NO: 1, and
 (xi) the amino acid sequence of residue 2792 to residue 3185 of SEQ ID NO: 38.

8. The composition according to claim 3, wherein the immunogenic Rh molecule has an amino acid sequence selected from the group consisting of SEQ ID NO: 51 and SEQ ID NO: 52.

9. The composition according to claim 3, wherein the immunogenic Rh molecule comprises at least one contiguous amino acid sequence selected from the group consisting of:
 (i) the amino acid sequence of residue 1141 to residue 1627 of SEQ ID NO: 3,
 (ii) the amino acid sequence of residue 1160 to residue 1370 of SEQ ID NO: 3,
 (iii) the amino acid sequence of residue 28 to residue 766 of SEQ ID NO: 3,
 (iv) the amino acid sequence of residue 282 to residue 642 of SEQ ID NO: 3,
 (v) the amino acid sequence of residue 233 to residue 540 of SEQ ID NO: 3,
 (vi) the amino acid sequence of residue 28 to residue 340 of SEQ ID NO: 3,
 (vii) the amino acid sequence of residue 1277 to residue 1451 of SEQ ID NO: 3, and
 (viii) the amino acid sequence of residue 29 to residue 766 of SEQ ID NO: 3.

10. A method of treating or immunizing against a condition caused by or associated with infection by *Plasmodium falciparum*, the method comprising administering to a subject in need thereof an effective amount of a composition according to claim 3.

11. A composition comprising:
 (a) at least one immunogenic molecule of a reticulocyte-binding protein homologue (Rh) polypeptide of a strain of *Plasmodium falciparum*, the immunogenic molecule consisting of an amino acid sequence selected from the group consisting of:
  (i) the amino acid sequence of residue 2184 to residue 3113 of SEQ ID NO: 1,
  ii) the amino acid sequence of residue 2027 to residue 3115 ID NO: 1,
  (iii) the amino acid sequence of residue 2027 to residue 2533 of SEQ ID NO: 1,
  (iv) the amino acid sequence of residue 2098 to residue 2597 of SEQ ID NO: 1,
  (v) the amino acid sequence of residue 2616 to residue 3115 of SEQ ID NO: 1,
  (vi) the amino acid sequence of residue 1288 to residue 1856 of SEQ ID NO: 1,
  (vii) the amino acid sequence of residue 297 to residue 726 of SEQ ID NO: 1,
  (viii) the amino acid sequence of residue 34 to residue 322 of SEQ ID NO: 1,
  (ix) the amino acid sequence of residue 673 to residue 1288 of SEQ ID NO: 1,
  (x) the amino acid sequence of residue 2030 to residue 2528 of SEQ ID NO: 1,
  (xi) the amino acid sequence of residue 2792 to residue 3185 of SEQ ID NO: 38,
  (xii) the amino acid sequence of residue 1141 to residue 1627 of SEQ ID NO: 3,
  (xiii) the amino acid sequence of residue 1160 to residue 1370 of SEQ ID NO: 3,
  (xiv) the amino acid sequence of residue 28 to residue 766 of SEQ ID NO: 3,
  (xv) the amino acid sequence of residue 282 to residue 642 of SEQ ID NO: 3,
  (xvi) the amino acid sequence of residue 233 to residue 540 of SEQ ID NO: 3,
  (xvii) the amino acid sequence of residue 28 to residue 340 of SEQ ID NO: 3,
  (xviii) the amino acid sequence of residue 1277 to residue 1451 of SEQ ID NO: 3, and
  (xix) the amino acid sequence of residue 29 to residue 766 of SEQ ID NO: 3, and
 (b) at least one immunogenic molecule comprising a contiguous amino acid sequence of an erythrocyte binding antigen (EBA) protein of a strain of *Plasmodium falciparum* having an amino acid sequence selected from the group consisting of SEQ ID NO: 5, SEQ ID NO: 7 and SEQ ID NO: 9, wherein when administered to a subject the composition induces an invasion-inhibitory immune response to the strain, and wherein said composition is substantially free from other proteins of *Plasmodium*.

12. The composition according to claim 11, wherein the immunogenic EBA molecule comprises an amino acid sequence selected from the group consisting of:
 (i) the amino acid sequence of residue 746 to residue 1045 of SEQ ID NO: 9,
 (ii) the amino acid sequence of residue 761 to residue 1271 of SEQ ID NO: 5, and
 (iii) the amino acid sequence of residue 755 to residue 1339 of the SEQ ID NO: 7.

* * * * *